United States Patent 12,642,819 (COMPOSITIONS AND METHODS FOR TREATING INFLAMMATORY BOWEL DISEASE) - sequence listing, part 98

SEQ ID NO: 51 - DNA, 6526473 bp, Parabacteroides sp. (residues 1-2,175,491 of 6,526,473)
  modified_base (119641)..(119740): a, c, t, g, unknown or other
  modified_base (322374)..(322472): a, c, t, g, unknown or other
  modified_base (1117848)..(1117947): a, c, t, g, unknown or other
  modified_base (2004405)..(2004500): a, c, t, g, unknown or other
  modified_base (2099111)..(2099209): a, c, t, g, unknown or other
  modified_base (2101884)..(2101983): a, c, t, g, unknown or other
  modified_base (3108513)..(3108609): a, c, t, g, unknown or other
  modified_base (3112703)..(3112795): a, c, t, g, unknown or other
  modified_base (3194904)..(3195001): a, c, t, g, unknown or other
  modified_base (4750489)..(4750586): a, c, t, g, unknown or other
  modified_base (6478209)..(6478308): a, c, t, g, unknown or other
tttcctctctgaaaaataaatgtttttattgcttattatccgcacccaaaaagttgcatttataagttgaactcaagtctcatcattacctgtttccccataagaagcacgcagtttcaaattattcacccattttacatctttcatgaaattttcttcgctgattctccaactcgcaccgaatgaccagaaattaccccaacggttatttttcgaaaaacgggaagagccatcgtgccgataagaagcggacagatagtatttatgagcataatcataattcaaacggccgaaatatccttctttcttataggtatcagtatatgaggaaagtgaactgatatttacaaagttgccaaactcattaattccggatatggtttcctgggttttcattgcatataagtattcatatttgtatgaataattttcatgacccaaaagcacatcgaaagaatgtttgcctatcgatttattataagtgatcaattgattgaatgtttgagtcaatgaccgggttgacatttgatttaagcgtcccggtccggctgtaccatcccctacatgtggattctcgtactcttttcgacgataatcgacattatttattgaataattagctgtcagattaagaccttctataggagtgatagtgaaatatgtatgtccgatttgattcatacgggcaaactcgcgcatattaaattctgtttcggcaatagcatcgcgaccattattcgataaacgagtaccgtcataatcataaacatactcattcggatcagaagtaacctcccctttgctattcagatattggccggtagacaaatcatgtttatgaacaggatagataggtgccatcacacgagtaaaacgtgttaaattgctataagaggatgaattagaagatgtagagctcgaataattagagatggtacgtgttactcccacattcaaaccggtcttaaaccatttcaccggatatacgttatagtttaatcgtcccgaataacgttcaaaatccgttttaagcatatagccatcatcactcaaataaccaatagacgcatacgtatcgcttttatcagttttcgtattataactcaaattatattcttggcgatagccggttttaaaagctgcatcttcccaatccaaatcatctccccattttaaagaatttgcagcgggattcaaacgaccgtccgtaccaacgatttcattatcagcaatacctgtaaaaggattatattttaatgtacttccaatttctgtcgaggccagcgaagctgcttcagaagctgttttaccagaagatatataagagtttttaagcatctgccactgtatcggatagtaatcccaaataccagctttagcataatctgcatatgctctatgtgaccatccctggttaatagtcaggttcacaccggtaccaccggcttcgcgtccttttttggtagttattaaaataacgccatttccggcacttgaaccgtataaagaagtagaagctgcatcttttaatattgtcatcgactcgatatcagacgggttaatatctcctatactaccattatagatagttccatccactacatacaaaggtgaattagatgcattaacagaaccgaaaccacgaatacgaatagaagcggattcacccggctgacctgttgccgctgtgacttgtactccggtagcattcccttccaatgccgcagttacattggtcagtgcccgcttctttattgtttccgtaccaacagttgatgcagaaccggtaaaagaagatttcttttgcgtgccataagcgactacgaccacttcatctatttgttcagcgtcactctttaatacgactatttgttcaccgtctttgattgcaatttcctgagactccatgcctacatatgaaataaccaatgtttttgaaccagccggtatattggcaattgtatatcgcccgccgacatcagtgattgttccgatagttgtaccttttaccaaaacggatgctccaattacaggctcattatcttcctccgaaattactttgccagtaactctagaaacctgagcagtaaccattcctatgaacaaacacagaatggttaataacacttgtagttttcttttcatctctttcaatcttaatattaatactgtatttagtttttgcattatacctgtaagctacttaactttcaagtattgcgttatcatacaaatctgctgatgcaaagggagctccaaactatatatctctcaaaatcagaccatcaccccatcaacccaaggttaacaaacaaaaaagacctaagatttttttaagcaaacagagcataaaaaaggccatagtcctatgtgaactatggccttttttaataatctgcaaatcaaacagataaaaggatatatgaaaatcaaacgctaaaaaatccacctcttaacaggaaggaagaaaaagggcttggttaatttttgttatataaagtctccagtacgcggtattacgcttttttttataattttgttttcacagtgtaacagactgtttaaatgcaatagttcacatagtactcatgttccgaaccatcttctaaagacttattttttacgagcacgtgcagccgcctccttagccttttgggcttcacggcgggctttctctttggctctgagtttttcctgatactctttttccttttgcttgcgctctttttctttcagcttttgcctttccttatactcgcgctccttctgcttacgcagttcttcacgggctttcagcttggctttacgatcggcttccgcttgtttcaacttattcttacgttcctgttcaagctgtttttcacgatcagcttttgctttcagaagcgctttttcttcttcctgctgttttttcagttcgtccgcacgctctttggctttctgctcctgcagttctttttcagccttctgctgtgcttcaaactcttcacgggccaccttcttacgggctgcttcctcttcagcttcacgtttacggatcgcttcgatctccttcaatgtaagttctttctcttccggggcctgaacggcaggaacactatcctgtggtgttacagttgttacagttgttaccgtttccggtataaccggttgcacagaaagggtatcgagaacttcttcgcgacgaactggttcttctgtttcttcttccggacggatttcttccggctgctgttcctcttcggctgcttcttctgtcttttcttcttcagcttccatacgatgcttccagcgggcagccagttcaggaacctcttcgccgtagttttcttcgaagaagttgatatattcttcgagcgtctttccacgcatcagcgtttcgtaattatcgtcggatatcggaaggatagccacatttttatccaaagcctgggcgtaaccgtccttagcatatatcatcttataatactggagaatttcattgattccgttaaatccgctgatattgagcattgacatcggacctgcttcttcgaaggtcaggtcgaactctttcaccataaagttggcaaagttgtaagctgctacggcaaatagtaactggttcttatccacgcttccgttcggatacatcaggatcatacggtatgaagtattcggttcggctgtgaaagtacgtgccgagtcggcagcagacaacgaaccgtcttcacccagaccaaaacgcaggttccaggccataccggttacactaccctgcatcagcgtacggccccgaagaatacctttcagcatttcaccggcaagttccgtaacatctgcagtcggatatttttcaacaagcgctttcaacgcggccttaaagccttcggcatccccggcctgcacatatgtcagtgcatcaaggaacataaacttaggtatcaaggtagccaacggatatttagcagttacatcccggtaattcttacgaacggcactcgtgtcgctagccagatagctactataagtttgctgatagatcgaatcctgtacggagtccatcatacggatattatattcataattcggatcggctatggcgatcgtataatcagcatccgggaaggaattcgtcattttggtcttgtactcggcagccaacgcggtattgcccgtacgaagtgccatcagataaacttgataataactttccaaacgatgcgagttatccgggaaacgacgttccagttcctcaaacgcctctatcgacaatggcagatcttccagtttatctttatagatcatagccatattatataaaccgtcctctattattatattggaagctgcaacttcttcttcagtaaacggcaactgttgcaaataatactcgcgcgacttgggatcatctgccgcgactcccggcagaccggcttccagtgagtcagtctgcagaggcagaccgtctgctccgacggcaccagagtctgtttccgccatatcttcttccagagggccatcattgaatgtagacatttccttcttacggcggcgccagttatcttccagtgcacgtcgtccccacttgcgctggaattgtgctttaccttgtgaaacagtagaaggattatagaaatagaaagaggtcccacctgaagtggtcggcaatacaataccgcccgtctctgtcccgggacgatcgattcccgttcccttagcagcctggtcagccagataggcttctttctcagccaaggctttggcttcctcttcttctttctttacctgttcgataatcttatcgatcacagccagcctctccggctccggcatcttggccagggtctgtaaactatcttgtaaatgaacagcttccacgtgtacaaccagttcatcgagcacggccgaaagcttcgatacacgcttgaagtctttatattctttctgtatccctgacaaagcaccgctaaaacagggttgagcctttacataatcacgcatggtgaaatagatatcccccagtttgatctgacagatcgctttctccaacccgttctgcgtactcttttcgatacccagttcgtagttcctgatggcattcacggtatcctcacgattcagatagatattacccaaagcataatacacctgatccagataatccttattcttatcgctcttcgccatacgtgtaagcatcttgaccaccttctggtaattgttgccggtaaagacttcggtctgacggatacgggcagcaaattcaagttcgtaaggcggattggcccgggctacttcgttgaacatcttataagccatcccatcctgatcctgcgcagcatagatctgtcccagcaggtatttcatacgggtacgctgacgtttgttcttttctgatttgatagcggacttgaaataggggattgcatcgtcgaactgtttgttcttcaccaggtaatcggcatatacggaagcatactgtttcaggttctttttaggtattccattggtattcagtttacccagaatatcttctgcttcgtaaaaccattccatttccgaatagcagcgtgcctgccacaggcgggcttcagccaccatctcttcatcctgcgaataatggcgggcaatataggaaaatgtagcggaggcttgcaggaaatcggcattatagaattgtccctggccaatgagcagccagcattttttcagaaaagggttatattcttcctgctcctggaaggcacgttgtttaggatcgttccgccatccgggcttcttggcaggctttgctttaatcgaatgaagcttgatcgccttgtttcccttttcgatagcacggtcgaaaggtcctccggtttctttcttgtctttcggctgtgcactgatcggatacatgtggatcatttcggagtaactttccttataaccggtctgcatacctaataaagattcatcgaaagaagttttcccgttaaaatagatattataacgagacgtaaaagcatgatagaaccgacttgatttggtgtttttcttcgtgctgcacgaccaaagcaagagtactacgaatattgaaattatatagtaaaaacctctcttcacgtattatgatagctctttatcatataataaactaagaacaaactgttttattgccttttcgtaaagaataatacgcctttcagaagcaaaaagaccaataccagaaccaggatgataaaggcaccggaaggtacgttcagaaaataagaaaggatcaggccggtaacgcatcccaggaaccccagaacgatgctacctacaattatctttttaaagtcggaagtgaagagattgacggtgatctgtggcaaagtcaaaagactcatcagcaacataatccctaccaaacggatagacaagacaatggtaacggcaataaagaacatcatcatatattcgatccactttacatgaatatgctgtgtcttggcaaaatcactgtcgaaagcaacatatactatttcccgtagatacagggcaaagacagcgatcaatacgactgcaaaggcggctatccagattatatcagacatggagatcgtcaggatattaccgaacaggtaagccgaaaggttcggtgaatagccgggcgtaaggaaaataaatatcacccccaaagccatacccagcgcccagacaccggctatcgccgagtcttcgcggacattctgcgtcttgctggcccactccaccccgaaagcggaaaggacggaaaagaccatcgccattaggatgggatttgtccccaggtaaaaaccaagccccagaccaccgaaagaggcatgtgttataccaccgctgataaacaccagccgacgcgcaaccacataggttccgacaataccgcaggtgatggcggttaacaggctaccgatcagggcatgttgaaaaaaagtatattgtaatagatccatattcattccgtatgatggttcgtcttatttgtgcaatcttatcttcatatccaatacgaggtgtagaaagtttcactgggaagaaacaaatgtttcacttaagagaaacaagtgtttcactagggagaaacaatctttatatcgaacacttgttgacgttctctaccgtttaatgtattctcctctcaccgacaataaggaatgcttcatccttcagggcatccggcaggttcacggcacgaagctggagactacggagccacccggccacctcgatatcctgcaaggtatagagcacttcacgaaattcgttgacggcttcttcatcgtattcgtcaccttccagtccccggaaacgatccagttcctcatcgtcgtaatattctatttttttacttacggcagccagtaagctatcgcgttcgcaggtctcatgctgtccgcaacactcttcaggtatttcgcgggcttcggggatctcgctgatctccccgcgttccagcatcttctgcagtttcttatttctgaaataaccggctacggcggcaagaacacccagcacgattacacctatgatgatataccacatattaaacctcctctacagtataaccagtatccctaagatcatcccagtaagcagggtaactcttcgttaccactccgggatcggctatctttattccctgctgcaaaaccaaagcagccggggcaaaagccatagccatccgatgatcttcgtaagtggcaattaccggatccgattccggctcgcatctttctccgttccattccagtatgctgtcgttgctgtcggtcaatagataaccgagtttacgaagttccgttttcagagcttcgatacgatcggtttcttttatcttcagtgtttgcagcccggtgaaacggaaggggatatttaataacacacagacaacaacaaatgtttgtgccagatccggctcgttcacaaaattgtagataagtttctttgccacattcccattgcgtttcaactgcacaccgcggtcggtaaaagtggtgccgactcccagttgggcaaatagtttcgctccggcagcatcaccttgcaaactattcctgaataggccgagtagttctatttcagcgtttttcgataaagccatcatggaataccagtaagaagcggcactccagtctgactctacagtaaaacggatcggtttatattcctgaggaagtatcttgattgtctgtccgttccaggtagctttcacaccgaactgctccatcaactgcaatgtcaggttgatataaggacgggaaataatattcccttcgaggttaagcgtcaaaccattctccatcagcggagcgatcatcaataaggcagatatatattgcgaactgatacctccgttcaatgaaatctctcctccctgcaaagcacttccgaaaatacgtaaaggaggatagccttctttttcgatatattcgatacgggcacctaaagaattcagtgcatcgaccagcaatttaatagggcggttcttcatccgttccgttccggtgatcgtccattcaccgatgatcttggaaaggaaagcggtcaggaagcgcatcgctgttccggctgcttttatatcgaagtcactactattggagttcaacgcccggatcattacctccgtatcatcacaatcggaaagattctgtatatcgtaaggactataactcagggcattcaatatcaatgcacggttactgatgctcttggaagcaggaagttgtacggaagcccggatagctccctccgggccttttataagatatttcattgcttttgtctgttctttaaattagaagacaaaagtacggaaattattctacttatatacaaaatgaagttcagttcacctgtcattaaattcttttaccgcatcaaacatggcgataatattctccggcggaacatccggaagtatattatgtacagtattaaagacaaagccaccaccggacgacatgatctccaaacgctccaacacctgttcacgcacctgatccggtgtaccgttattcaacgtaccgacggtttctacaccaccaccccagaaagtacaatcctgtccgaattcttttttcaggaattcaggggacatatccacagcattggtttgtaccgggttgaatacttcaatccctgcctcgatcatatggggcatcaatgaagagatagagccacaggaatggataaaagtgtgcatctgactatgtgatttgacataatcacataactgcttatgacgaggtttgaaaagggtcttgtaagtatccggatccatgaacggcccggtcgtcattccaaggtcatccccgaaacggataatgtctacaacgtcgccgaccgaagtacagaccttttccagtgttgccaggtggcgttccagtaattcatccaatacacgctccacctggtccggatcacaaagcaggtccatcaggaaattatccatccggcgcaggaaagtaccccattcaaaaaggttacaaccacagacgatcatcaatgccttatccgttgtttcccgcaaatgcagggcatttgttctcaactgctcccagaaaccatcatcggcagcatgatcccagggactgtgcacgtaacgcgaccaaaggacacgtcccatctcgtcatccagattatcatagctgtcgggatagccatccacataaggaaaataagactggtcaaagaaagtggcacccttcggcatcattgccaatacccgctttccgtccgtatcatagcagtgataagagccattcggttgttctatcgggtggaaccaggcaggatataaagccttatctccgtttgccaatattgtttcgtgccagtcggaaggttgtaaattaaacgtccggccaatatcgaggacatcgataccgaactgatcgatcaacgacatatccggttgcgccagttgctgcacgacgtcgtatatttgcaccggcaaatcggttcgtcctaaatgtttcagcaaattggaataggcaattgccgagatacccgaactgggagttgctcccatatcgaccggaacacggtcgggctctttatgagctatagctgataaaacacgttctcttgaagtcattatttttcatttttcaattttcaattctcaattttcaatttccatcactctcccccactcattccaataatgaaagaagcggtaaccaatacagccagaccggcatacatccaggctttcgtctttgtatccgtagctttccattccccccgatataatccccaaagggtagcaaagacaatggtcaacgacatcaatatgccccaggccgtaaacgagaactctcccatccggctttttcccataccataaaagataaagttgacaaaccagagaaagccggccaaaccacaatagagataattgcttgaaactgtaatatccttagtctttacaaaagctttcaggttgttattctttttcgacaggaacagacaccaaagtgcagtagccagaaaagagccgccgaacaatacgaaaaagactggcaatgtctggaataacggatcgatacccgaagcgaccaaggctaacgaaatgccggctccctgttctatacccaaagcttgcgatgctccggttatgccgacaaagaaaaccagtaccagccctttcccgaaattaagttccggattcgcttccggtccggcaccgttatctttccggtaaccggcatatccactcagagctataccgactgcggcaatcaacagacctacaatcaacatagttcctccggattgttgcaaaagaatactcaaccgcccgtcgatagccggaggaatgatcgtccccagtatcatcatcaatcccagagaaagcgaaaaacctaacgagagtcccagataacgcagggaaagtccgaaagtcagattacaaatgccatagataatccccagtaaaaagatccatcccaatgtctgtaccgggacatcggacagcacattcataaagccaggacaaaaaacataacatgccaccacaggcacgatcacataagcaaacaaactatatatcagccaatagttttcccaggcccagttacgggtctttccgaaaggaatcgaaaaactacctgacgagaaagctccgatagctatcagcccgattccaaataataattcaaatgtcataactcttattggttttttcttctaatattccgatacgcacaagaggtactgttgcaaatgtcacagccataaggtcgctttctgacctcatcccctattcctataattccgctaaccgatttaatcggttgcatcagacaagattcattgatcgtgatccccgtcggatgatcgccgatataagcgaacagatcacgctgcccggagagtgcccattcgcaataaccgggactataacggttcgtgatcttctttccctgttccatcatcgcattctccaaatgcagctgtaccttatccatcgcattctcaacggtcgccgagccaatcgactcgactacaaatgcttccaaaaaatcgccattctgttgataaacatgcgacaattcggtaaaagttttccccgccgtacaaagaaataaagcgatccgaccggctcctttcatataaccgctaatcttacgtcccgtatgcaagcgacctgaagaacaagtgactattccttcttttatatttacttccggacaatccagtatacgatatccgccgatgatctctttcgaatctttcaattcgtcaaaggtcctctctacaatctccgcaacgagaacatagctctccgaatcgggaatctggaggtactccatcaataccggtatttccggacgaacctcctcaaacgaaaatgtatatgactggaacatcattttcccgcattaaaatcagctattgcctgatagaacgctttgatatttgcatccggaaccaaaggcggcatatcacagccggaagagataacaaagtttttatactgcaatgtttttgacagaagatcggctgtggcccggtacacctcttctgatgtagcttgtttcaggatgccgacagggtcgatgtttcccatcacaataaggtctgacggacattgttccaatgtctcaaccatatccacagcatttccgaaatgtagagctgcagcgccggaatcgatcatagcttgggtacattgtcctttatttccgcagttatgtaagatcacggtaaagtcttcatcctgtaccgcctccactatctgccggacataaacggtcgaatattcctgacagtcctcattggaaagtaacccggcagccggttcagccatgatcacacctgttgcaccgatcgctttcagctcccgacaataagcagtaatataagctgtacatttatccaataatgttttaatcacatccggctcgatataaattccgaccatgatctcggacatatcgtagagtcttcccgctaatgagaaaggaccgatacaaccggacaggacaggtttgtcctttatgttttcaacagccaggcggtttgctttcagatattccggcatccggccggcagataaagaaggaacctgcagattgttcacggtttcttcatcatataccagtcggcctgtaacactgggcacttcatgttccggcatattgattgtacaaccaaaagcctctgcctcaacagtcaaatccattatgacggtacaagccgttgtatggtaagtttccgtcacattcctgattgcctgatagtgtacatttccgtccgtaacggcatcgatcacctttttcccgatcgcttcaataccgggatgagtcataatagggatagcgatccgcttgtcactgtcttgtaattgtttgataaacttattcatacgctatcaggctacgattgaatccaaccagttaatattatcctgcggatcacgggcataagcatccgctccgatcttttgtgcaaactccgcattcaacggagctccgccgacgacaactttagtattgggatattttgcccggatagaggcgatcatcggttgcatattactcatggttgtagtcagcaaggcagacataccgcaaacggctcccggatgttcatccaatgcctggatatacttctcggccggcacatccgtccccaggtcgatcacttcccagccggaaccttccaccatcatacccgtcaggttcttgccgatatcgtgcaaatcacccataacggtaccgataacaaatactcctttccgtttgatctcaccattctgaaaatagggtttcagatgtttcatagcactgttcatcgctttagccgacaacaacatttgcggtacgaatatctttccttccgtaaacttattgccgacccggttcattgccggaatcagggcttcattcagtattgattgaggagataagccgctctccaaagcctcgcgggtcagttcatctgcaccgggcaagcctttcattgccggcggatagggcgatgccagattgatcttgccgaattccacgcattcgccaagtttactaataatgtcattcatgttcaataatatttaaagcttattcatttcgaaagaggcactatattcagtccatatggaaaacttcttccatagccgcccaccattctccgggcctacggttctctaaggcttgctgacagggatcggtcagtttccaccattcctgcgtaatgggatcggcagccattcgctgcatatctttttcgtaatcatcaccgatatactcataataactatacaacatcccgtccctatagaaaatcgaatagttccgtatattgcactcttttatcatcgttaaaacatccggccatacggcagcatgtaactttttatattcttccagcttttccggttttacaccgataacactcccgtaacgtttcatacttcttatgtatattagattaagtatcacaaagatattggatccaaaacaacaggagttttcaatattcgtggttattttgactgtttccgacatttaccggcctgaaacggtaaaacgcaaaaagcccctggcaaaagtgaactgccaagggcttttattatctatgaataatcaatatccaggattctgtaccaatgatcctttggccagatcgatttcagttaaaggaattgcccataagtaattcttgttcggatcgaacttgcgttgttctaccaatacctttttcccgtcgaaagtcataccgtaagcaggtttattcacacaagcttcggttgtcttccaactacgggtttcaaacaaatggattccttcaaaggtaaattccacacgacgctcacgtctaatggcatcacgcatttgatccttcgtcagattagccggtaaaggaggaagttccacacttggacgctgacggatcttgttcacagcatcatatacggaagcatccggcccatttaattcgttctgggcttctgcgtagatcagtaatatttcagcatagcggaacaggatataattagtccagccgggatattcgtttcctacatttttcggattaatatatttacgcatggtatagccggtacgggtggcattcccattccccattgttccttccgtgctgtatatctgccctccgaattcacagccatgccacaggattgaataagccaggcggggatcacgattctcaaaaggcctatccggattatataacttcgagtcctgaatagattttccatccatacattcataggaatcgataagatcctgtgtcggcgacaaggcttcccaaccgcccatcatcaacggagagaagaattgatcgatccagctgcctgtgtaatcataatccagtgcattctccatgtactgatgatcgaatatcacttcactgttattttcatgttcagcagagaacagatccccataattaccatacagactataaacccccaagttcattacctcctttgccgcactggctgccatatcatatttcttcatcaggtaactgatatgggctttcaaagccaaagcagcccccttattggcacgccccaattccgtgttatcggaacgggttaacggtaatttttgtgctgccttatcgcattcctctacaataaacttatagacttcttcttccgtattgcgcgaagggattgtttcattcaactccaaagcacgagtcagaataggaataccaccgtaaaactttagcaaagtggcatggaaataagcccgtaagaattcaatctcaccaatcaggaccgttttctcatcttctcccatatctaccttggctatattatccaggaagatattacagcgacggattccacggtaagcatcctgccagacctgcttgaagtgaggattcgaagccgtggcggtacaagacgatatatcaccctgctccgcatgaatatgaacgggcacagcattatccgtataacaatcgagcataaccatatggttacccgattgaaccaggtaacgataagtggctgcggaatacttcacagcatcttctttcaccatccagaaagattcgtcagaaagctggtctgttgggatcttgtctaaaaaaccgtcgttacaaccggttccggacaacaaaataagtgagataaataaatatttcagtttcataattcgtctacagtttattaaaatgaaaggttaacaccaaatgaataatttcttgtcagcggataatagctgctagccacagataagtctttcatattgtaagccgattccgggtcaacaccgtcaaatccggtaatagtgaacaggttgtctacactaaagtacactctcaggcgagtaatacccgaatctgccagcacccgtttaggtaatgaataaccaatctgcatatttctcatcttcagataagaggcattctgcatccagaaagtagaagtcatccagttctttttagaatctttcatagacaaacggggatacgtagcatccaggttatccggtgtccagcgatccaaatggtattcggttacttttcctccattatagaatgctttgttgatctcatccttcacaattgcattgaccattccggctccttgcaacaaggctgaaaagtcaaagttcttatattcgaaccccaaacgaagtccgtagtttattttaggaaaataagtacccagcgactgacggtcgttttcatcgatcttcttatcattattcaaatctttatattttaggtcacccggcttagcaccccagatttgtgtcggatgcccatcgatctccgcctggtctttaaagattccttcacaaacatacccatagatattattgatcggatcgcctacagaacgtccgggagtatcacctccgctcaggtcagtaatttcattatgcacataactgaagttgaatgttgcataatatttgaaatcattgatctggttgttatggctgatctgcatttccatacctgtattacgaaccttaccggcattctgcatcgggggcttcacacctacgatctcagggataggcaactccagcaggatatcttttgtattctttacaaagaagtcgccggtaaaactcaacttgccgccgaaagcatccgcatcgacaccaatatctatctggtctgtcttttcccaggtaatgatcgagttggccattttttcattgatagaaataccgggatacaacatattaccgaagttgtagttctgaccgaacatataggtattatagaaggcataatcgccaatctcctgattacccagttgcccccaggaagcacgcaacttcaggttatcgacccaggaagccgtaaagaaactttcttcagacacacgccatccggcagaaaaagaagggaatgctccgaaacggttatctttcggaaagcgtgaagtaccgtcatatctgatattcgcctccaacaggtagcggttgtcaaacgtatagttcacacgggcaaaggctgaacgcaaagcgtattccaccatattcccttcggtagcctgtgtcgtaacgtcaccggcatttacttcacccaggctgttattcagaggaagatctttacgggatgctcctaagatacgatactggttatataattgggaataccccaacagtcccttcaggtcgtgtttgccgaaactcttcgcataatccagatacgcctgaagatttacttccagcatcttgttgtccttgttttctacggaactgcgggtagtacggataggatccgtagaatctgctgtatagaatttcatacttctgaggaaagtatgttcgtctttcaggttaaatgtggatgaagcatttccccgcaaagataatccctcgatgatcttataggtaaaagaagcacttccctggaagttattattataggtacgcgcaagaccactttcccgggctgaagctaccgagttgtgctcattcttaaacaaaccgtagtttccgttctgaaactgaatcggagtgacaggtgtctcacgaaaagcataatacatgatatcagtcataccggttgcaggagatgccatacggctacgataggccgaaaggtttaaagagatattcagccggtcgttgatcttggcatcgagatttgaacggacattaaacttattatattcggtattgggtatcaacccttccttattatgataaccaaaggaaagggaatatttaatggcctcagacccaccgttcacactcaaatggtgattatggaatagtccgttttcgctaaacaaagcacctaaccagtcgctattggcaaaatgatccggatcagaaccgtctctgaatttctgaaggtctgtatcggaatacagtccttccaatccgtcattcttataggcctcattcaacagcacaccatagttatatgaatccagatatttcggtaagcgggttgcttcctgccaacctacatatccattataggagatgacgggcttacctacagaacctcttttagtagtaatcaacacaacgccgtttgccgcacgcacaccgtaaatagaagctgccgcagcatctttcaatacggaaatattctcgatgtcgttcggatcgacattactcatcgacgactccacaccatcaatgataaccatcgcttcggaattaccgagcgtaccgacaccgcgaacacgcaaagcagctccgtcggctcccggctgtccggcattctgtacaatggtcacacccgaaacgttacccgtcagcatatttaccggatccgaagtcgttctgttttcaagcacatctgctttcacactacttacggcgccggtcaggttcaccttcttttgtgttccgtaaccgacaacaacgatctcatccagattctgtgtatcgtccagaagagagacagaaatatcattccggttgttaaccgggatttcctgttccatatagccgatataggagatttgcagaactgcattccggggtacttccaacgtaaaacgtccgtcgaggtcggtcactgtcccgtttgttgttccgcgttctattacattcgctccgatcaccggttctccggttttgtccttcacaacacctgttacttttttctgttgctgcggggtcgatgttttagcggtctttagtgaaataacgatcattttaccctgaatagagtagcttaatccgttatccaggatagccgacaagacttcatctacagatgcatccttaaaattatgatttatctgtttttgctcattcacttcatcttttttatagatgactgaatactggagctgtttctccacttcctccaatactgttttcaaagggacattcctgaactgttgagtgattttctgggcgtccaccgataatgagccggatagtagtaaggccagtattaatgaccttcccacgagttttttgtacatcataagatagatagttagttattagatttaatacatatataaacaaatgcgctattgttttctgatataaatatcttgcccctgccgttcaaagcgtatcgggatgatatcggacaatgccctcaggaactgatcgatagtctcctcgttccgcaatgtaaccctgaaggtggcgtctttatcaagcgttgtatccagatgtatcttcacatcatactttcttgacaggcggacagccagttcgcccaaagctatttcgtcatattcgacccttccttctatccacgaacggtattgcgaggcctgtacctgatggcaggtaaagtctttcttttccctatcgaagcagagcatttcgccgggcttcacttccatttgccggccttgatacaaaacatcgacagctccttccaataatgtcgttgccgaaaaagggtcttccgggtaagatgtcacattgaacttggttccttttaccacaacatcatagcaaccggtcttcaccagaaaaggagttttatcggattgcttttccacttcgaaataagcttctccttccagttccaccaccctgttctttgcattaaaattatcggcatagcgtaaagtcgatccggcattcagccaaacaacggttccatcggtcagcatcactctgcttttctctccgtaggcagtgaccaaggcaaagtaagcgggatctgcctgcttactaaaaagggaaaatatcccataagaaccacctaacaatacgactacgattacagcggctactgccactgcctggcgcaaactatatcgcttcggcctcaacatctccggcatgccgccttgtatccggacgcgccgttgcaaatgtttccattcgctgacgacatcctgcgcaggtacagcagattgcatccaccctttttcccacagacggaacatttcataattatccgtacaggcattcacaaaccggaagagctcttcctcttccggtaatgtgatgttcccttcaaaataatgcacagctaatcgatgaatattctccttttccaattccataatttttgatttctatatgatgtaacaactcatttctattttacccaaccccgggaatccgttttttatccttggaactactttttcttttaccgcctgcgtagatctataaaacataccatgaaataactttttcgtattatatgaaaatttagtggcataatatatgatgctccagtagcctcagaggaagattatagacagctgatagagaaaagaccgacaagtctaatgttactttctaatcggataacaaccatgcaataacaataatataaatatcaagcggatacttatctttgaaatatttggagaaggtcattaaggctttggctatatgcttttcaacagcggtcgtagagatacctaaagcttcagctatctcacgatttttctttttatcaaaacgactcataataaatacttcacggcaacgtagaggcagtgtgtttataacggcgtccacctgttcctgtaattccttatataataaggtacattcgggagtcaggttaaaatcaagactataaagttcttcttttccgggaagagtggccagatactcgacactatgctgttctactatttgaatatgttttaaataattcagacaggcattccgaaccattgcaaacaaaagggaagacacggatatggcttctataaactgacgtttctcccagaatttcagaaaactttcctggataatatcccttatggcctcctgatcttccacaaaacgagaggcatacccgcgcaaacgaggataataacttctgaaaagaaattcaaaagcctgatcgtttccgttctttatttcccgtaataatgttttctcgtcggtaaaatctgccatacatcaccatgtaacgccattaataaaagacaaatgtagagaaattattctgaagtttacacgacaaacctttcttctactttatacaagcactgctttatgtcagatataaaacaaaacaacccttcggatatgtatacccgaagggttgttaataaaaactaatggtcttttttgaccgggaccttcccttctatttcaatcattccaatatggcagcccaacctccgttacgaaccatacggatcgttacgcttgaggaagcatccacttttttactatcctttttataatccatggcctggcgttctgcatttacgccatcctggaaatagtccatattaaattctttaccttctggcaagaaatcaaggtttatcgttacctcttttcctttacttccggaaattcctccgatataccatttatctcctttgcgacgggctacgacaacagcctcgcccaccttggcatacaagcaacatgtttcatcccagacaaccggaacggaagccataaagtccagacaatccttctcccggttataataaataggattatcggccagcatttgcaatccactttcaaaaacaacatacaaagccaactgataagcacgggtaccgacgctcatagcattggtgcgggtataatgtacatcttcgggatgcgcactgaccatagagcccggcgtgtaatccatcggaccgacaaagtttcgcatgaaaggcaaatagatactgttgtctggtatgcaacggttcccctgctccattcccagtacaccttcgtaagagatcacattcggatacttatgttccagtcctgccggtttaaatgagccgtgaaaatcgacaaacaaatggtgcttggctgcttctttggccacacgttcataatagtttaccatccactggtcgctgcgatccataaagtcgatcttcactccggcaattccccattcgttgaatttctggaacaggtcgaagttattttccactgccagccaggtaagccaaaggactatcttcacattccgttctttggcataactgattagttcgaacaaatcaattgtgggattgggaatgaaaggattataagtcgtctcggcccatccttcatccatcagcatataaggaatgccattggcagatgcaaaatcaatataatatttataagagtccatattataaccagacttgaaatccactccatataatgctgcatcatgccaccattcccaggcaacatgaccgggttttacccagctcacatcccctaatacattcggagacgacaacttacaaaccatatcgtttccaatcagctgccgatcgtctttggtgatcatgaagaagcgccacggaaagctacggctaccggaggtgtgtgctatataatccgcttcttttacgatcttcagactgcgatcgccatcttctccaaactccaaagggcaattcgggaatacagaagtcaggccatttcttcctgtacttttgaaaaacatacagggataatcggacaaatcggcttccgaaatcaatatcttatacccttgctcattttccagcaggataggcaaataggtcatcttatcatttgccttatagtctgttgtatggatatgggtataaggatattcatatgatgttttaaaactgttgggttgcgagatatgggccagataatcgctgccgaaattgataccgcaagtttcatcataaatatcgatctgtcctttccgggctgttataaaacgataggcaacaccgtcgtcgaacactctgaattcgacagaaaaatctcccttaaagttaagcaacagggtattgcaattgttttccaccactgcattcttaaaggtaatctcaggttttatcgtttcatgaatagtcccccgcttgacagttttcaacacggctgaagtacccaatacctcatcacccaaatccaaccggagggaacaatctttcaacagaaggtcgtcgccggcataaacagagtaagcgatctgtccggcagtattgaccgagactttcaacttcttatcaggagaatacacatcctgagtagcagcatgcatttgtgctgcaaagagtaaaagcagcagccagaggctactgcttattgatactacttttttcatatactagttttatttataataaggcaaagcccaccacacatcattcatataatcgtttgtcttattggataactcagccgttccattcagatagttggcttcattacgtaccatttcatcttgcggataaggcagacgaccgatcatttttccatttgtaacgcttaacttgctggggttcggattgtcggtaatgacactcggataatgtgtacgtctccaatcgttccagatctgaagaccattgccgaacagtgccagccatttttgtgtgatcacttcatccagcgcacctctcaggttcattgctttattttcacccagtgtgggaaccgtattgacatagttttcgatttcctcatcggtgataggagctccgatcagagtcaacgaacgcatacccatgcggataccttcccggtaatatgtatctgctgttccggatatatagcctttcaacacagcttcagccaacaggaaataaacttcggctgcacccattactgttgttgcgcctttccggttgagcaccgtttcttttttgaatgaagcaaagccgtaacgtccgatattaggagcaaaatcttcatcaaatgtcatatctttcaaaacgtcatcgacatcatccatttcacatccgttcttcataccttcgtaatcctcataattgtcgtaaaactttccttcgccatcgtaaacggcagctatatatttcaggcgcggatcgatttgagaagcactgtatttcttgaatgcagaaatataggtacttgaataacagtaaccacgtgaaccgatataatacaagatatcggtagcccatgtgttatcgaggtaactgggttgtccggtcactgtcggctggtgattgactttcgccacttcatccatcgaagaaataactccggctgcaacggctttactcacgtacgccttagccagctccggttctacattcgatatctggatagccatacgcagcataagtgaagctccgaatttaatccatttgtcgcggctaccgccatacaggatatcgtcttcgaaaaccggatcagaagaattttgcaatgtctgaactccatcatccagtaattgcagaagacctttgaatttatccgtccccagatagatatccttttcagttctgtatacgggataagaaattccattcagagcctttcctccttcatcataaggaacgggaccgaatgtatcggtatatctgctcgatacaagtgcacggacaatatcgacctgtgcttgttttgaagctgaagctatttcctctgccagttgatcgtccatcaggttgatataacgcaggtagtctacacaataagatctccatatgcttgagtaaacgcccattgcggttccgtccaccgtaaatgtattaccgacaatatcgtagttaccattggtcgttgccgtatattgcatcatcggagcgaaatatttcatttcgccggaaggtatactcaatgtacctactacattgtggaagagattgtctgttcctatcttcgtcactttattgggatctttattcaaatcaccaaagtcagcattacaattagtcaatgtaagtcccagtaatgccatcgacaaataatttattatatgtttcattgtttaccagtgttttaaaatttaagattcagatttatacctaaagaacgtacagcaggttcaccaccgttttcaacaccttccatacccacggtcgaattcagtgagaatgtcggatcacaaaaatcgcttcccctccagatgaagaacggattactgaataccaacgagacattagcctgtttaagcatcagcttggagataaagcttaccggtaatttatatcccagcgatatttccttcatacggataaaaccaccgttatatacgttctgagaagctgtaacactctggatcttacctaacttcaacggatcgagaccagttccgtttgcataatagtcatcgcgtccgggcactgtattgatatgggttccgtgttcatacatccaacgggaagtctttgaataatacttatgtcccagacggctgtcgatagtcaggttcaaataaaagtctttgtattccagatgactggtaagtcccataatcactttcggaatagcagagcctagataagaattataactcttatcgtacaatgggtatccattggcatcgcgctgaatattcccggagtcgtcatatagatagtctgagccgtacatcacgccgtaaggttcaccctcgatagccattacactcattgcctccacaaaatacatctgtatgctcttcaatccgtcatgcagtttcttcaccttgctataattgcgtgacaacgtaaagcccagatcccaggagaaattttttgtctcgacaggccttccgctcaatgagatttcaaaaccatgattgttcacagaaccggcattcatcaggctggatgaaaatccagatgaattaggaatagggatctgcaagatctgatcttttgtcgtattgttatagtaggaaacatccaagccaagacgatcgttaaagaaacggatatcgagaccatattcggccgaatttgttctcatcggcttcaggtcaagcggtggcagctgtgtattctgaatatttccggggtatacaatcgaacctgattcagtgggaaaacctccggggaataagccgtaatacatatccaactgataagcattcgtatcactaccgacctgtgcccatgaagcacgtatcttaccaaagctgaaccagtccgggcgatccattaactcagaaaaaaccaagctacctccgacagaaggatagaaataagagttattctgtttaggcagagtagaactccagtcgtttctggccgtaaatgataggtaaagaaagcggttatacgacaggtccaaagaaccatacataccccacatacgtttattcatcatataaaaagaggctttctgatttttggcattgctcggagtatataaaccttctgcaatgaagtcggcagcttctacactggtgctgcgggttttctgtgaccagtagtttcctcccatcatcgcatccagtccgaacttaccgaactctccatgatattctgcatacaaatcactattcaccagcaggttcttactattatacttgctcattccaccctttgtcatataatcggaacgtccggccatagaagcccagaaacctgatccctgcggaatagtctgatcggtattaaaatcggtcatttctaacccctggcgataagtgactttcaggttattcagtatcttataactgacagaagccagtccgttgccattatagctctggtcgttattcttatattgatacaatatataataaggattcagtgcaccgtcccagttgttcatcagaccaccggtagtgatatcacgtcccatagcttccagtttcttcaaatccgtatcggctcccataatgggtaataccgttgtcgggttgaattgtccgtgtccgctttccgggcgttgatgggcatttgttacattaaaattgattttgaaatcataactcaggcgtgaagtcagatcaccattcatacgcatggtcaggttatgtttcatataattaaaagctggagtaatatccttgtaatactcgtttccataagcaaaacggaaagtggctttctttgttccaccgatgatagagagcgtattggctgtattaaaaccattattataaaaatccatcggtttataacgggaaacatatttatgttccgagccatcgataaagacagatgtcgtatttggatcgagtttcgcgccataagcgtcttcagaaacagccatagcatcggccagtgtcttcggatagtttcctccttgtccgctaccatacacctgctgatactgggccaatccggcataaggcatcaacatggatgtatttgtgttgaactcgataccgattccctgatcggctacacctttctttgtagtgataaggagagctccacgggaagccttcgagccataaagagcggcagccgacggacctttcagtacactgatggattcaatatcatccatattcatcccactcaggccatcaccataatctgttccaccgaacggactcacatcggtattgttcgagttatcgacaggtacaccgtcaataacatacaaaggtttatttgtagagcctgatgctatttcaccaattcctcttaaaactattttagtagaaccgctacgtttattcccggtaatatccaatccggcgatcttacctcccaaacttgtcagtaaatttcctgaatgcacttcgcttatctccgatgcggataactgggcggcagaataattcaatgcacgttcgctctttgagatacccaaagctgttaccactacttcatccagcaattgggtatcttccaataattgaacagacagggttttctctttacctactacaatttcgcggttcttatatccgatataggataccagaacaaccggacttccggatatctccagtgagaaattaccatccatatcggtaattgtaccgtttgtagttcctttcactgatacattggctccaataaccggatcacctttctggtcggttacacgtcctgtgattatccgcgtagattgttgttttacctgagccgaacgggcagataaaacaatctggttattctctttcagaatataagtaattcctgcttcagcaactattttatccaatactttcttaatatctccactggttgcttcaacagacacaactgtgtttaaaccggtcaggtcttcattatagaagaaacgataatcgctattcttttcgatatctttaataacttcacgtaaaggtttattctttgcagcgattgaaatctgggcagcaattgtcatgcctgaagaggcaagcataagactgcataaagctgcccgtaaaattatttgcttgatgttactcatttttagatgttttttaatcgtataaaagattataaatagtaactttacaagcagaatcaagagtcattaaactccggagataaccggcaagttatctctataaacaaggagaatgattgattctgatttgtaaaagatcgtgtgagtgggacagctctcctttggagcctgtcccctttttttgactattcttacgtcataggctattcaatttttaagattaacaatttatttattctcactacggcttcgcatccaatatgatcgtgtctccatgtgactcataaataatgggagctgtaaggcttattatctctattacattgtctaagctattattcttgataacacccgaaaaacgatagttccttatcttgtctgatttaaactcgagccgtacattgtacattcgattcagtaagagggcaatgtcatccagtttctctctttcaaaagcgagttcgttattacgccacatgcgggcatacgatacattctcggacttaccgacagtcaggctcctgctttgccgattcagactgacatgctggtctggagttaggataaccgaattatccttccccgttccggcctttatacttccttcaaacagggtagcgacaaaatcgggatcttcattatatgccttcacattgaatgatgtgcccaaagcctccacctccatctcaccggcttttacaacaaaacgatgttccttatctttcgacacctcaaaataggcctccccgtttaaagagacattccgttcttttacaccgtaatcacttttgtaacggagctcggtatgcgaattcagccagaccttggttccatccggtagtacgatacttgccctctgtcctttttctgccgatacgatatattcactggcaacctgcgatttattcagagtatataaataagaagaaaaaattcctatacataataatatagtagctgcataaggcaagaaacgagtaaaagacaatttggatttaatactcctagtttcccgtcttttttgtgattcctctatttcatgcattctttccttaatgcgcaggaacatccgtccctgaacttctgcaggcaactcttcatcaaaggtttcaatccaccgctgttgataaaagttcagaatttcattcctcgacgcagaattacggaaccattccagaagcaactgctcttcctccggagatgtttcgccacgcataaagcgatcgagtagctttatatttatattgttttttgtcatcgtttaagttgtatatccgaaaagaagggcaatcccttacaaggggagtagaaaaaactcatatttaacattcattagccaatacaaccagtaatatagccaataaatgatcattggataatttctctttcaaaaaacgtaatgaacggtagagttgagtctctactgttttttcggagatcgatagacgggcagcaatttctttattcgacaagtgttctctacggcttaacttaaatatttcttttctggacagaggcaattgttcgatcaggttatcgatatagagacggagtgaatctgcatcgattttctcttccatcagaaagtcttcattagtttgctgctgggacaatgcataaaatgcagactcagataacaggcggttctccgtttccttatagaccatattacgggctatagtaaagagatacgcatcaaaacccttatccaggtctatcgattcacgtctctcccatattttcataaaaacactctgagtaatatcttcggacaaaactctgtcatacaatagcgaattgataaagttgaagacatgcgaattatatttccaataaatagattcgaaagcagtttcatctccttccttcaggcgtctcagtactgtagcatctatatccttcagtgtgtgcttttccatatctctttctctccattaactccggcaaagataaaaatttatttgaatgttagattccttttagcgacacagaaataagacttagaaatatattgatctataaatgatatgcacccttttcctgtttcaggtacaatctacaacatgcccctttttattgacctagttcataaaggactaagtcatttaatctgtcagatgaaagaatatataaaaaacgaacattatgatttaattataaaatatctgcaaggaggattagactcgcagggtatggatgatttctatacttgggtgaatgagaatactgataataaaaagttattctttgaaaccaaggcgatttatgatgcttgcagtaattccgacaatctgacagaggatatccggaaaagctgggatcgtcttttacaaaagaaaggaatacaatgcctgaaaaagagtaaatggcatcaatttggtaattatgcagcagtgtcactggtcgcagtctgtcttacctctgctttctttctctctaatgaacatgagactaaaatagccacccgttatatcggaggggacggcctggatgcagatgtggtcgagttgccggacggtactcaagtctgtttaggttcgaaaaccatattccggtatgaaaatgactatggtaataaacagagaaccgtttatctggaaggagaagcctttttcgaggttgcgaaagataaagataagcctttcatcgtaaagacgaaggaacaggatatcgaagctttaggaactaagttcaatgtgacagcttacccttccgactccctgctcacgaccaccttattggaaggatcagtccggttgacaacagaaaacaggtcgcagcgtgttatacttaaacccaaccagcagctggtgtataaccgcaatacacatatcagtaatattttcgatgtagatgcgaaacaatatacatcctggactaccggatattattactttccggaacagagcctgaaagctattctttaccggttaagtcatgtctatggagtacagtttactgtcaactccgaaaggttaaacagacgcactttcaccggaacattctatcgcggacaaagtataaaagacattatggaaatcatccacctttctataccgatcagatacgagatagatgaacgccatgtaacgatttcagaaatataagcagttgttaatctttaaaatgaggatagtatgagtgagtaaaaaggtaaaatcaaaaaagaagagaaaatcttgccggattctctcttctaaagtgtgtgattcaattaaacttccattgccgtggaataatgtttaatcttaaaacattcaaaagtatgaataatcaacgtatagttgtttccgtaaatctgaaaagaactataaaaatcatgaaattaaccgtgttaatgttaaccgtttgcttgtcgcaaatggtcgccgcaacttatgcgcaaacagccaagctaagtgtttctgctaaagaagaaacattagagaatgtactgaaacaaatagaaaaacagtctgaattcctgtttttctataatctggaagagatcaataaaaatgagaagatctctattaacaaaaagaatgtagatatcgaagatttactaaaagcgatcaccaataagacaggtttgaaatatacgatcaaagaccgtcatattgtattgacatccgaaaattctcccgtatctgtgggaagtacacaacaaacccgcaaagtaaccggtgttgtaagtgacgctatgggacccgttgccggggcgaacgttattgaaaagggtacttcaaatggaacaacgaccgatatggatggtaaatactcaatagaagtccctgccaatgccatcttacaagtttcttttatcggatatatccagcaggatatagcggttaagaaccagagtgtagtgaacgttcagctgagagaggatacacaagcattggaagaggtcgtagtagtaggttatggtactatgaagaaaaaagacctgacaggtgctgtcgcttccgtaaaaatggatgacgctcctgtcggaacagtttcaacgatcagtcatgcactggctggaaaagcagcaggtttacaggttagtacgatcagtgcacagccaggtggccagtctacattccgtattcgtggagctgcttcatcagataaggcaggaaatgatccgctgatcattattgacggctttcctgtaagcgacccgggatcactggatagcggtaaccaatacaaggacggcaataaagataatatcttatcttcaatcaacccgaatgatattgaatcgatcgaagtattgaaagatgcgagttctactgctatttacggtgcacgtgcaggtaacggtgtgatcatcgttactacaaagcgcggaaagagcggagctgccaaagttcagtattcaggatctgcttctgttcaggatatttccaagtcttatgagatgttggatgcatcgggcttcatgcaggccactaatgattacagaaaagaactgtggctgcgtacgaacggtatcggtatctacggaggcaaatcagaatcagatgttacttcgcctttcgttcccgactatacagcagaacagatagccaatcccgcacataatacgaactggtttgatgaaatctcccgtttagggttccagacttctcataacctctcgataacaggtggtaatgacaatacgaaatacctggtttcaggaaactacttcaaacaggacggtgtaattaaaaataatgccatggaacgttattccgcacgtgtgaacctggatcagaagcttagtaaatatgtaaagatgggtgtaaacctgaatgtttcacgcaaccagtatgacaacatccctctgggtaacggacagaatgaaaatgcaggtattttggtttctgcagcccagttcaacccgacgctgccggtacgcgacgagaacggcgaatatacaatgaaccaggacgcttcattccttccgaaccctgtatctctgttggatattacggataagacaaccaaagagcgtttgttgggtaccgtattctttgaagttcgtccgattcaggacttaatgttgaaagcaaacttcggtatcgaccgcaactatcagaaacgtaaacaatatatgcctacaacaacgttgtatggagccagagagaacggatccggatatattgcccaggccgataactctgactacctgatggaattgacagccaattataccaaacagttcggcgatcataacctgaatgccttggtcggccattcttatcagttgttcgattatgaattcctgtcaggaaaaagcaatgacttcattacagacggtttcttatataacaacctgggagccggtaatgcaaaacgtccgactgtcggatcaagtgcaaccaagtcacgtatggcctccttcttcggacgcgtgaattattcttttaaagaccgttatttattgactgctacactgcgtgccgacggttcttccaactttgccgaaggaaaccgttggggatatttcccttctgttgccgccggatggagattcactgaagaagaatttttacagccactgaccaaagtactgtcaaatggtaaattacgtttgagctatggtgaaactggtaatgcaaatgtaggggataaagcatacagctactataaagttggtaataacaatttctttggcggtagtgctatcaacggcgtttatctggaccagatgggaaacaatgaacttacctgggagaccacacgcgaatggaacctcggtctggatctgggcttcctgaacggacgtatcaatgtaacagcagaatacttccataaagtaatatcagacctgttgaacgaacgtaccttgctttcttataacgaagttaacaaaatcattgcgaatgttggaaaaacacagagccagggttttgaactgacagttaacacgactaatatccgtaacaaagattttgaatggacttcagacctgacattctcgttgtatcgtgacaaatggaaagaacgcgatccgaattggaaacccagtgcatacagtgaatacaacggttatatccgttcttatgccggctatttgtcagatggtttggtacaaccgggtgaaacaatagatcatatgcctggcgcacttcccggacaggtaaaaattaaagatatcaacggatatgtctataatgaagatggttccatcaaggtcgatgaacacggtattccgatgaaaaccggtaaacctgacggtaaattggatgatgccgacaaagtgatctatggctctgccgaccccggttatctgttcggcttcaacaacacattccgttacaagaatttcgacctgaatgtatatttctacggccagtttaataaactatctgccggtagctataagaaaacctggatcagcaataacgtcaacgacttgcgccgcggttacaatcagccggtttccgtaagcgatatatggagctctacgaacccgaacggtacgctgcccggttatttccaaacggaaagtgcatacggtacaggcgactattattacgaaaagacctggtttatccgctgccgtaacattaccttaggttataatataccgatcaagaccagcaagcatatcttgtccaatgtacgcgtatatttcgatgtgaacaacccgttcgtcatcactccgtacacaggtcttgacccggaaacagatatttcaagcgcggaaagtactccttccagcctgcaatgggcttatccgaatgtacgtacttatagctttggtttggatattacattctaatttattaatcgataaaagaagatattagatcatgaagaaattattatatacattaatgtgctgctgcgcattaagctcatgtaccgacctggaaccggaaagatatgatgccatcaatcccggatttttcccgaaaacagagaaggatgcggaagcattggttacaggtggagtttatgctcctttccgttgtgataattatagcggtatatttaacgttgcttccggtgtacagatcatcggtgatatgtcgacggatatagccgtttgctgctgggttaatgatgcatggatcccgttgaccagccataactggacgcccaatcatcaatattcaacgatcaactacaccaactatgcaaaatacctggggactatgacgttaaccctggaacgtatttccggtgtggaaatggctgatgacgtaaaggcacgcatgaatgccgagatacacatggggcgtggttggctagccttcttattatatgatttttatgggccaatccccattcctacattagatcagctgaataatccgctggcagaagagatcataccgcgtgctacccaggaagaaatgactacgtttatcgaaacagaattgaaagctgcattggaaggtcttcctacccgtgcctcttctttcggacgtttcgacaaaggtttggcatataccgttctgatgaaattctatatgcatgaaaagaactgggcaaaagcggttgaatgtggtcgtgaactgatgaaagcagattatggatatggtctgatggatacgtaccagtctatcttcacactggaaaatgaacagaacaaagaaatcatttttgcctgtacggaagaaagaggaacccagttggaattatggcacgatcactgcctgccgggcaactatccttgcaaaaacaactctatccaacgctgggacggtttcaaagttccctggccgttctatcgcacattcgataaaaaagacgatcgcctctccgtactggttggtgaatacgttggaaacgatggtgtattgttcaatgaagaatccgatattatcaagcacggtaatacctattcgggagccgtaccggttaagtatgcagaagaccccgagtcaaccggcgatggtagccagatcgactggatcgtttatcggtatgccgacgtattgacattattgtcggaagcgattgtccgtaataataatacagttagccaggaagcactggatttactgaaccaggttcgcgtacgtgctaaactgaatgcatataccatgggcgatgtgaaaggtacagacgatttcctggataaagttcttcaggaaagaggatatgaactatggtgggaaggcgtacgtcgttccgacctgatccgccacggtaagtttatccagaacgcgatagacagaggatccacgactaccaaaccggagtttgtattgttcccgctgccacaagcagtaatcaatgaaggcaaaggaattattatacaaaacgctggatattaattcgttttttaatgatttaaatatatatttgcattgtgagaaagggccgctttaattgcggccttttttctctctgctaacaactaaatatcatgaactataaacacttattcagcactttgtgtgcatgttttctcctgctaggagctacgcaggtaatacaggcacaagattatcctgccaatccgctggaaaaagaaggttaccgcctgatcttccacgatgaatttgaagggaatgaaattgataaaagtaaatggattccggaatatttgccctcctggcccaaagacaggagtatctgtacacctacttatgagatgaaagacggagttatcaaactcattattgataaaaactcaaagaatgaattcgataaaagcatgtatatctccgggtttatgagtgccagccgtacagggcttcaccattatgaccctaaaaagaaagcactgcacgagataaagacagaagccactcagatcaatcaatatggttactatgaaatgcgtgcaaagatgcaaaacggaggaggtgtacattgtgcctggtggctgatcggcttcgaggatgatccgaaccaaagctgcgagatcgatattttcgagatcttggggacagatgtgaataagatatgggcaacagtgcatagctggaaagactctacgatccagtatcatacagagcatccctggtttgccaacaaaaagttggcagaagaatttcatatatatggatttgactggacaccggaaggggttgctgtctacgtcgacggcatacaggtgatgaagcataaagcagctataacatatccacttatccagatcatctctttttatgataaccgaaaagcgaaaaatggctggaccggcacctatgatccatccattccttaccccaaaagttttgatatcgattatatccgcatgtataaaaagattccggatggctataaggccgttcctgccaatgaactgcgcataacctccattgaaccggcccgtatggaagttacggaaggaaaagccgtattgcggaatatcgacgggcatatcactcgtgaactcctatatacaccatcttatgtgaatgtccattataacgacggaactgtcactcaacagtttgttgaatgggaagcgctgagtgatgaagcattcagccggattcaaaaagccgggactgtcattgtcgacggtaaaataaccggtctatccgacactctgttaaaaggggaaaaggcaacattgatcattacaaccaaataaaaacaaatacttatgaaacatatagcgattatctttttttccatcagcatgttgttaaacctgggaacgggatgtacctcggaaaaacaacacctcacattccgtggtatatatgccgatgatccggccggaacagaaggtttacataatccggaacgtggtttccgcttagaagtggcattggatgtcacagaaaagaattatgtatgggctcccgataaatatcccgatatcacatcctatctggaagaagaagcagagaagtatgcttctgatagtatatccctggtgcagacctatttctatctgacaggagcagtcggaaaagcgttgacaactgacgattttaatacgatggatatctttttcgataaactgcgtgaactcgggatgaaagccgttttacgttttgcctacgaaactcaattcatgggacgcgcggctaccggaccgactttggatgatatcatccgtcacacagaacaactcaaaccatttctggcaaagaataaagatgtcatccaggtcgtacaggccggcatgataggtgcatggggcgaatggcatagttcattccatggactggagagatcagacgagaccaaacgtaccattctacaacatatttgccggatgacacccgaaggacgttatatccagatccgtgtaccggaatataagaatctattagatccctcctccgatgattataaacgtacttcttttcacgatgattttattgtcattaagaaacatctttgggatggaggaatgtcggaaggaacaccggcatacgaacagatcatgcgtgaatcggcgtatcttccggtcgatggagaattgccttggggtacatggagtatgaatgaagatccggacagcccggaagctggctggataattgacggacttcaaacggcaaagcgtcttttcctgcaacactatacctcactgagtgctattcataattataaggagaaaaacactaatgacaaatattccatgaaatactggaaggaaacacctgtcacggaagctttcctgaaagagaataaaatgcctgtttcaaatggttattttaatactaaagataaaaagattgctgaacgtaatattttcgattatatccgggatcacctggggtatcggattgagttacaagatttaacgatatcacccgccactgataaaaacgataaagaaatagaactgtcgttgatcaaccgtggtttttccacactgtttaatgaacatcctgtttatttcgtactgatagacaatgaaggaaacattgtccataccgaattaactgatgccaacgtaaacgaatggcaaccttacaacccggatgatacgctttgtactccgttgatccataaaatcaaaacgaatatgcatataccggaaaccgtcatccccgggaattatcagttaggcctatggattccggatggggctgatcgtttgaagaaaaacgcccgctatgcaattcgttgtgccaatggcgatgtggaatggcgggtctccgaagacaatcaatatggtataaatattttgacaacattaacaatctgataaaatgaaaataattaatattctgttgctattatgcttttcagcagtgatacaagcaagcccgatagacgggttattagagcgtattgacaagggagcttcccgtaagtttgtcatcgaacagatcaaatcgcccaccgacttttttgaactggatcagaaaggagataaagtcgttatccgcggtaataattatgtcagtattgcaaccggaataaactggtatctaaaatattatgcaggcattcatctctcttggaacggaatgcaggctacgcttccggaagtccttcctgccgtaacaaaaaaagaacgacatgaaacaggcctgaaactacgttatgacttgaactactgtacattttcttatacaatggcattctgggactgggatcgctgggagaaagagatcgactggatggctttgcatggtatcaatctgccattggccatgacaggggtggaaagtgtctggtataacgttttgaaaaagttgggctacaacaaggaggagatcaacgaatttatctccggtcccggttttatggcctggtggctgatgaataacctggaaggctggggaggtcctaatcctgacagttggtatcggcaacagaccgttttgcaaaagaagatactgaaacgtatgcgtgaatacggtatcgaacctgtattaccgggatattccggcatggttcctcacaatgccaaagaaaagctgggactgaatgtttccgacccgggcttatggtgcggttatcgccgtccggctttccttcagcctaccgatccccgctttcaggagatagcttccctttattacaaagagatggagaaattgtttggcaaagccaattattacagtatggacccgttccatgaaggaggtaacgttgccggagtcgatctggatgctgccggcaaagcaattatgtctgccatgaagaaggtaaatccgaaagccgtttgggtagcccaggcgtggcaggccaatcctcgttcaaagatgattgagaatttgaaggccggagatatgatcgtcctcgatttgtttgcagaaagccgcccgcagtggggagacaccgagtcgacctggtaccgtaaaagcggttttggacaacacgactggatctattgtatgctgctgaattatggcggtaatgtcggtctgcatggaaagatggcgcatgtaatcgatgaattctataaggcaaaagaaagtcctttcggtaaaacgttatgtggcgtcggtatgacgatggagggtagtgaaaacaatccggtcatgtttgagttattaaccgaactcccctggagggagcaacggttcgataaagaggaatggctggcaaactacgttcgtgcccgttacggttctgaaaataaaacggtggaagaagcctggacgctactcagtaactcgatctacaactgtcctcctcaatccgttcagcagggaacacatgaatctatcttttgtgcacgtccgtcggaaaatgtttatcaggcctccagttggtcggaaatgtctgattattacaatccccaggatgttatccgtgctgctcgtctgatggtatcggtagccgatcagtataaagggaataataactttgaatatgatctgattgatattgttcgccaagccattacagaaagaggccgtctgttatacaaagccgtgatggccgcttatacatcaggagataagacactctttgaaatggcctcccggcatttcctgcaactgatccttttgcaggatgaattattaggaacacgccgtgagtttatggtaggaaactggattgaccaggctcgtaatctgggaaagactcctgaagaaaaagccttatatgagtggaacgcacgtgtacagattaccacctggggcaaccgtcaggccgctgacgaaggaggtctgagagattatgcccacaaggaatggaacgggatactaaaagatttctactacatgcgatggaaagcctatttcgacaatcttaccctgaagatgaatgggaaaaatccagaagaaatagatttttatgcattggaagaaccttggacaaaagagacggatccgtatccatctaaacctggaaacgactgtattccaactgtaaaacatatattcaaagaaatatttgaataacaaaaaaggagtagaattatcgttctactccttttcttttttactttatcttctcaaaccagggtaatctttccagaggagcattcacctctatagttttagggccacggaattttttgccggtatcatctctccactctcctttgggcaacataaccttacgtacatgttcttttgtcaggatcggagctaccaggtacttatctcccaacatgaactgatctttgcaatttacaaatccctgatgaggaaaagcatattccatatgacgaatgatcggttcgcctgtttgtgctgaagaacgtgcttgatccagaatataaccacccatcttttcatgcaaatgagcataatcacgacagatagccagatgcttttcatcgaggatgcgccaaggtgctacagaaaactgcatcataggcatcaatgtatgcacctggcaggaacgaacaatcaattcctgatccaatttggtctggtcaatacccaaaaaagaaccgaactgccccccaccgatcatatctggacaagcataagcatatcctaacagacccgcagcaatcatatcagggatcaacaagcctactgcattccaggaatagtctttatcccccaagcgttgcactaaaggttgccctcccatcttccaaccggcacggtattcgttgaatgggaaatccagacctatttttgcccaatattcacacatatctactgaagtagcgtctttatcatagaattctagatcgggatcactgtaaggaccgatatcacctgcatcaaatttgaaaccatccacaccgtacttatcctgcatattacgtaactgttgtttcaaatgttccgcagctgccggattactcagatcataacatgcactatatccgttccaccaaggaataatagccgcctggttagttccttttttcttgattaaataatttttttgctgcaattcgcgaaattctggactatccgggctaacaaacgggcagatccataacataatacggaatccgtctttatggagctgatcgatcatacctttcggatcaggaaaacgttcgggtttaaaatcaaaattaccataatatttctgccagttgtcatcaaccataaaaacacctacgggaaatttatatttcaaaatattgtcggcatatttcaatacatcttcctgattctgattgtacatcagttcaatccatgtgttatattgaggcatggaaaagaataaagagtcaggtaactgaccagagggagggaaatattttgcagatgcggctatataggcatctttcaacgtattacctgctaataccggttctatattttcaaaatcggaaaacagctgtaatattccgttttcaaacttgaatgaaaaaggtttatcactccatatgtatcgtccctctgatgaaatcaaaaggggaacattctgattattcaaattctcagtagaaagatcgaacagacgcatattttccttaaacggcatttgagagccaagtgccaccatgcctccccaccatttttcattttccaaagaagatattttggattcatatttacttcctgcccaacaaggtaatattcctaagattacaaccagggacaacaaaaaggctttcatcgaatgcttcatgtttgttttattagatttattaattcccccgcaaagatagggataacttcttattttctaaacataaaagtggccaagagattcagatctcccggccactaattatatatcttattaccgtcgattaaaacgtatgatttaggaattgtttagcccaaatcaaattcggattcatatctacagctttctgaagcaatacttttcctgtagcgtcattgcccttataacattccaacaaacctttcagataattcaaattagcaatccgttcatcccgcgaaccgtcttctccgaatttggaataagcatcgactgttactcgtccggctaactgttcttcaatttcagtagaaagcttttgaagtaactctttcgattccgcctgtctgccggcctcattcattgccagagcattgaataaagtattctctgaagccaactccatacgccgtcttcttacctgactgtttgcagcaatgtcaaaactttcttttgccttcttcttgtttcctaaagcctgataagctttacccagataataatatcccttagcactatgcccgccggtttccggccggcctacttcgagattttctggatacagatcggctgtttcaaactcttttacagcttccttataatttcctgatttaagtaaatccatacctttcaacaaatgagaatcgacataaatatcatgtatctcacctccgccttcccaaacgtggaaatgacgggcagtcattatatcgatagccttatcataagctccggtttcattatacaatgtcaataaacgaataacggcttcatcatgtttcataactgttgacaagttcttttccaataccgctaaacgttcggttgccggtttcttttctttctcatagagtatatccagttcctggaaaatgcgaggatcctgattattatattcaattgctttctcataaccggctattgcttttcctagctcgttcaagcggttataaccaaagcctaagttacgataggcttgggcgaaaaccggatcctttgctactgcctgctcccagcaagccattcctttctctttctgccccaggaaataatacaaattacccagataataaggagcacgggcatcttcaggagattccgaacaaacggtcgacaggatatttatttcctccaaacggaatggaaaacaccagtcggtagcaagtgaagaagctttcttccattgtgccaatgctatctccttcttccctgataacaggttataataaccattataataatatactaaaggagaagatgtgtaaggttcaccgatttgcagggctctattcagtaaaagagtagcttcctcataggcacccgcatgggcatattccaaggacatttccaatagttcctgcacccgaataataccttcaccacgctgtttctcagccctatccaggaaattcacaccattcccactcagaaaactttgctctgccatactccaataatccaatggatcgatagcgacaacctgttgtatttgtttcaacgcatcctctgtttgtccctgttttctcaacaaataagctttcagtgtcaaagcttttgtatctcttcctccgactgccaacgattgatcgaccagatccaatgcctcaggcaaatttccttttagggctgacaactgtgccaatgccagataagccgggtgttggaatgtcggataccaggtggctttccaatactggtctgcggcctctttataacgaccttgcatctgataaatcaatccgaggtaataatgcggttccggatccttcacaaccgtataatctttggccggacggagtaatgcacgtttcaaatgtttttctgccattccccattccccagctttggcataatggatacccataaccgtattcacacgcgaatcgaatgaatctcgtttcaatgcctcattatagaaatccatcgcatttaaacgggcattatggaattgctccacacgaagtccggcataatataattcttctactgtctgatagtctttcactggcttagtcccttcaacaacttcaggaagttcttttttctccaactccaccggttgataagcaaccaactcattccccttattatccagtaaaacagcacgaaggcttgtttctttcactgtagccggaaccgatacagttgttgtaaacggagttgctggatcgatagaaatcaccttctcaaacaatactttaccgtcctgttgtagcaaaacttttgcatcaggatatttagtcgttgcattaaatccaagaaaaacttttccggatgcttttttctccaggttaacagcagcatcgtcattcgcattcttcacagaacctatatcacgaataccataccaacgttgaacgaactcacgtgtttcccctggtcctacccaactataatccggttgattatccgaataagcaccgaccatcagttccagataatgtccgtctttgtcagatagcatcttattccacatctctccactcgggttgttgccccataagaaaaacttcttaccattgacaatatggtggttagctacatgtaccgtacctgcctgtttcccatgatcgtaaccggccaggaaattgtcttcgaagttccaggcgaagatagagcgggaattaccggtatagttcttccaccaggcaagtccaacttcattaccactaccgcgaaccgcttctcccataggccatttggtaaaatagaccttggaatgatccgtaccgaattgtgtagccggcggaaaaatgacttcataatccttattacaatgtacagaaacattggcccaataaagaatagactgtatgaacggcgtacgattaatgatcttcactttggcttccacccatgagcgattcggatagacagtgacacccaccgaccatttcatacgatgacgcagctccatttcacccacccagatcgttttacttccatctttattctcttctatcttccaatcgataggcatgtaactggaaggacgatgatgatgagggatattccattccactcctccggacagccaggctccgagcataccgatcaaagccggctttatacctgtctgccgataaaatatttcataatcattcgtcttatcggttgccgacaaaatacgtcctccgatctcaggcagcacgcaaacattcacatactcattatccagataaacggcatcataggttttgtctactttctcatccgttaatatatcatagagcggataaggataaatatgtccctgagctccctgatatacacgcccggtaaaaaagatagggtttacatccggtgccccgatttcataagtaggcaataccaatggtttctctgtaactttgacagtctgagcgaataattgagggactgataacagaagcgccagccctataataaatgtatttttcatagatcacttaatgttataattaataatggatagccggtgttttaggtatatcggcactataagcctccacttttcctattgcgacatcatatatacgttcattcgttgttgtcatagcctctgtcaattccggataaggaatattgcaggtcgtaacaactcctatattataattctctccatcgaaacggccgtagtaaggttgatcgatccactgaaaataatgcataccgaccaattccgggcgtgcaaaaccttgttctatatagttccggtatgctgcagcacgttcctgttggttcaggacaccgattatccctgtagcaggtaaagccctgtctacagctccctgatggaactccccaatcattacgggttttccgcttcgttcggcaatttcagctgtgggaggcggaaccaatccgtaaccatttatagaaaagacgtcgaaacgctctcctgccttgtaaagtaaatcagaacttaaccaggcataacgcattcctaaattcatatgattcttgtcaatcttgaccacttcgtcgcatgggatatcgacatacatcttcaccataattgttgagaactcatagaagtcattattagccacatccgaaggatactccttgaatgtacaatccttcaaagatgcaaaatccttcagcttcaaattccattttttatttacaaccgctatatctccctgatatttcttttccagccaattaataaattcatctttagtacgtgaagtctgccgggtagcaaacatttcataagccagattatgataaccgaaagcccattgaggttcgttccttaaaaaatagccaaccatatacggatcgtctttataatctgttaattgacgggcgaatgctttggcattttgcagatattcattagaaaagacatccggaaagtcacgataaagcgaaacagccgtacctggaaaatcacgtaaaggcaaaacataagggatacgacttttgcgggcaaaatcaatatccgaccagtttcccaccgtattaaaccgaatctttttcatcagattttctgtgagcttatcccattgacttctccaatcctgaccatacacacggatcatattggcaatataaaaatcaaccgccttgaaacctcttctatcttttacagcttctgcatacgtagcatctccctcctccggaagccactcgaacagatcttccataccattcaccggtccactggaattgggacctatacagtcaatacctacacttaaaaaggcatatccgtccggatcgaccagccaccaacgagtcccgtcatgctgagtcctgaaaaaaccggtgcctttaaactgtttctttttccaaccgccgaaccgtccccattccgaaggataaccgacattctcgatttctttggctatcgcctgattctggcggatcatatcctcttcatctttcaatttaccaagccactctttatctttccattgtcctaattggtcgataaccggagtagaaatagctggataaggatctggtaacgaatctgtaatagaaacagaagccagttcgtaagaagtccgataattactcccgtcataaggtccgaaacgaagaaccaccttaataatatcctccggagccaaccgattaccactgaccgtacctttcaactggcgaggagagcggggaacaaacaattgttgtgcatccagataagacaaaggaaaaacgacctgtgtcttcagctgcggcaacacgcccatcaaacaagagatccacggcatatccttatctgtaccggaggtttcacctccttgaagaacgatcttctcagcaacgaaattcttcatatccttataaaactcgatattgataacgccactatactgcgcctcaccatacagttcaaacaccagataatttccctggttccaaaccggtttgtcacctttttcccagatcacgacacccttattaccatcttcaggcgaaacatataatacattcttcttaaatatatcactctgcttcatacctgtctccgtgtctgcataacgggccgctatcttttgcatatcaaaagattgtacacctccatgctgagaattacaagccacagtcaatagccccaatagcccaacaactaatcctactacattctttttcataacctatctcctctgttttttcagatataaactactccactttgcccaggctttctcagagtcatcactatacttccggtctatttcctccattttcgccttatcaccaaacatacccgaaccaatctgctcgtatgctccgaaatcagtatgtccatcttctaaaagatttccccagaaatcatgcttaccggaaagaggcacatagataccagtattgatacaaggggaattcggttgtaactggtaacctctcaacgagcataatccttcaccaccgctaccgggagcgacaaaaagaggatcagccaccaatttctcaggatcatcaggcaggccatttttccaggggccgtagtaacagttatgataaaacagcttatcaggagcacctgtagcaggtttgaccgattcatcaaaagttcgagtcaatacttctccggtagaataggctgttctgaaataactctgccctgaagcataaaagatattattgtaataaacagcccccagcttactcttatctaccgaaccatcgttaccacagaagaaatccagatccactgtaccataatcgatataaaagacattattgtacaagatattacgatcactaatatcacattgcatttgtaccaggtgcgtctgatcgttttcacttatattataacgggcaatattctcaaacgtacgattcatcagcaataaaaaaccatgattattctgactgtaattatactgggcaatgcaacgtttgcaataaaagtcgaagtcgtaagcaaatccatcaccattccccggctgacgtcctgtatcataaacggcattatactgcataatcgtctcttccgcatcctgtatccaaatggcagccgtatgtggccaccagctttcgcctcccttcagatcaagatatccggaacgcatacaagtgcgtttagccacattatgttctatcatgccccgataacatccacctacaaaaattccgtctccacccagattttccatataattatgacggacattcagattattcttacagccgcgaacaatgataccacatttatcaaaacgttcgatacggttattttcaatcagtacatcgttcagggtcgtattcatacgattgttgttaatacctccccttttattctggatctgtactaatatggcacaactattataaccggtatattccgtatcaccgccaagctgtccccatatatcatggatatagcaatcacggattattatatgttctacctgttgattttccccccgggccagtgctacgataccctgccgtccgattcctagttcaggggcggcaccactagtaacttccatattctctattatccaccaagattgattgttgaggcggattccggcaccttcggcatcacctatattaattatcggtttagtctctccgccataacaagaaaggaggatcggatttcctttctctccggatccctgtaacttgagctgtcctttccagacagctcccgactcaaacaggatcttgtcacccggaagaaaggtaacattattcactttatccaaacttttccatgcagcttgaatagacaagccggatgcattatcattcccattgggagatacaaaatacgttttgttctgggcatagacaaccaaagtcataaataccagacatatcgataataaaatcttcttcattttcatgtgattagcggtaaatgaatatataaacgattatcagtaacccggattttgttccagagctccattagaaagggttacctgatcttcagggataggtaacagttcactcttaccttctacaaagttctttcctttgatagaattatacttttgagaatacgctttcatgatacttccaagacggccttgacgagccagatcccaaaaacgttgtccctcaccggccagttcgacacgacgttcatgccagataagatcacgtaacttatcttttccggtttccgtgattttcggtaacacattgtcagcggtagcattcaaacgggctctgctacggacttgttccaggtaatcgagggcttctgttgtctttcctaattcgttggctgcctcagccatatataacaatacatcggcgtagcgatagaagattatattcttaggacaatcactctggtcgacctgtgaacgctgtgcataaggaatataccatttctttggttgatatcctgtagaactggctttgttataattaatacgcccgtcaaagaattctccggggaaaataacagttgcattcagacggggatcaccatcttcataactcttcaccagatcctcagtaaggcaatgcatagaccatccgttatgccatttcacgggatcgttaggatcggcatcatgctcatagaaagaaaggatcgaaccttcattcgagtctgcccaacctgtaccgctgatactgtgctgaatctcgaaaagcgattcgatgccattctcatgctcgagagtaaaaacatccgcataattaggttccaaaccatactcgcccgaattcaccacttctttcagtgcatcataagcttcctggaatttcccctgataaatatacaccttaccaagcatggcataagcagccccttgtgtagcgcgacctaaatcagcagcctcatattcacttttcttcggtaaaagttcgattgccttcttcagatcctgcgctataaactcccaggtatcttcaatggaagcgcgggacatataatattcctcgtaagaaagtacatgatcgataataggcatccgtccatactgccgtgtcatgaagaaataattaaatgctctcaggaaatgagcttcacctaggaactggtctttcttggccggtgataaatgatcagcattagccgtaatactttctattgcctgagtagaagcggaaattcctctgaaaccttgcgcccacaaagcattactcacccagttggtgggaagattatcgaacttttgaagtgattgggctacagagcccaaccaggagaatgcctcgctattattattacctaaatccgaatcatccgaacagtcgtctccaattatcatgaaaggtgccaactggaaggattcattctgcataatggaataaataccgatgatcgaagtattcgcctcatcatccgtggagtaataggtctgaactgatgtctgaactaaaggagtcttatccagaaagtccgaacatgaacttaataatagtactattgataaacctacaagtatctgatgtgttttcataatatcatgcctctttaaaagttaataactgttccgatcataaaagattgagcctgcggatattgccctctatcaaccgaaagatctgttgccacctcaggatcaaagccgctataaccggaaattgtaaacagattctgtgccgagatatacaagcggatagatggcttaaagccttcagctaatctgggagagaatgtatatcctaactggatattcttcaaacgcagataagaaccattttctacataataatcggaattacggaagttacgactgttacgggtcaagtccttggtcggaatagactggacattagaggtattctctcctctccagtagtcgtccagatattcctggcgtacattctgcttaccatcaaatcgcatataataatacttagcagcattataaatttcattaccggctaccccctggaacaaaaggctcagatcaaaattcttataacttgcatcgaatgaaagaccataagtaacatcagggatcggatttccgataaagtccatatcgccatcgtcgatcttaccattattattcaagtccttaaatttgcggtcacccggtttggcatccggctggattaagctaccgtcttttacatacgcatcgatctctgcctgattttggaagataccatctgttagataaccatagaattgtccgtaaggtttacccacttcactacggataatattccccaaggctccctgcaaatcaatcaatgtatagtcatacgggatactggctaccaaagcctctgaggttccgagactcgtcacttcattctttacaagagcaaaattaccattgatactgtatgtgaaatcacctttacttcctttaaatccaagtgaaaactcgaaacctttattctgcatcccccctacattacgaaccatactaccaaatccggaaatacgaggtatttgttgcgtcaataaaatgtcttcagtctttctaatatagtaatcggctgttacactcaaccgattattaagcagacttaagtcgactccaaaattcaactgagtggatgtttcccacttggcatccagattaccgataccggaaggcagagaaccgtttattctgtcctgattttgccccaaggtataatattgttgttgtgaaatcggagttaaatagggataataggatttaatattttcattaccaatggcaccgtaaccagctctcactttgacattgcttaagacattttgttcccagtttttaaagaaactctcttccgataatttccaggcaagagcggctgaagggaaatatccccatcggttatttttagtgaaacgcgaagaaccgtcggcgcgaaaacttgcagttaccagataacgatccaataaattataattgatacggcccaggtatgacagcatggtcagttccgcaccatcgcctttagccaacgggttttcggttgcagaatcaaaataccagaactcatcactttcaataggtacattttgcttcgttacttcataagagtcatctgtataactacgggcagacatcgctcccatcaccgtcagatcatgtttctcgttaaaattgtggtgataagtcagcatattctcccaggtccaatcgatagtacgggatgtcttcctagatacggtattcattaaggttgaattatccgctgtttcataaaaaacaggaacaaaatcgctatcatgattatttcttactttaataccatagcgggaggtaaagaccaggtctttcgtcagattcaggtcagcactgaaattaccgacaaaatacaaacgtttgttttttccgttatttcgggcaattctaccagccggattctccagtctcatctttcgaatacctgtatagtaatttgtttccggattgataaccggtatatcgggaggagcaatcaaagaagaaaggaaaatactggtaggatccaatcttttatgatcggtcatagcaacagacagcgaggttgtgaactttaggaaactggttgctttaaagacattattctggtttaacgatatacgatcaaaatcggtagattttacgataccttctctcttataatagttcgcactaaagacagactgtactttttcgccgccaccagtcatacttatgttataattctggaactgacctaaatgggaaacagcgtcataccagtctgtattataaggcatattagttgtgctcgaatacaaaggatcttcatctgcatttgtataggccagattggataactccgcatattgtgaagaattcagcatagtaggctttgaagccaggcgttcaataccataataagcattgaaattaacctttaaatcaccggctttgcctttcttcgttgtaataacaactacgccgttggcacctcgggaaccgtagatggcacaagccgaagcatctttcagaatctcgatcgactcgatatcattaggactcaaatgattaatatcgctcattggaaagccgtccactacataaagcggagaagaatcattcggagttcccacaccacgaatctggatggaagccgttgcatcgggcgaaccggaccctaatgagacagaaacacctgctgcccgcccttgcaaagccgctaccggcgaactggttgccattttggtaatatcttcggcttttacggatgaaactgaaccagtcaggtcgcttttctttaccgaaccataaccgactacgaccagttcgtccaatgtctgggcgtcttctctcatcacgatactcaaagatttttggttagcgaccttgatctcctgcgataaataacccacataagtaaacttcaatacggcattttcagcgacttctaaagtaaactggccgtttaaatccgagatcgtcccgttggaggttccttcttctagaatattcactccaatgatagggccactcgcatcttttataacaccggaaattgttctttttccactttgttggggaactgccacttctgctttatacagcacaatatggcgatcttttataacataccttaatccggtattattagatatgagattcaatacatctttaatattagtatcttctttgtttatagagatcttagtgtttttattgatctcttccagattatagaaaaacaggtattcggattgtttttctatttgtttcagtacattctccaacgtttcattctttgcagaaactgttagttttgcagtctgtgcataagttgcggcaaaaacttgagacagacaaacagttagcattagcacggttaacttcataatgtttatagctcttttcggttttacaaaagcaactatacgttgattattcatactctaatagttttaagattaaacactttttccacggcaatggaagtttaattgaatcacaccctttagaagatagtatccggcaagatatttttctccacttcttactttttacgttatccactcatacattacatttttaaaggttaactaatccatatcgctcattccgaaatcgtaacatgtcttttatcaatcttgtatttgataggtacggacaggttaataacttccatgatatcctttatactttccccacgatagaatgtaccggtaaaggtacgtttgttcaagtctttcgattgaatagtgaattgtgcaccatacacatggctcaaccgatcgagaatagattccaatgtttgttcggaaaaataataataaccggttatccaggatgtatattgctgagcatcaacccggttcaaagaaatactttttctattccggttataaacaaactgctggtttggctgtaagatcgcctgcctgtcgatacccaaagtcgtcaaccggacagacccttccaataaagtcgttacaaccagcgaatccaacggataagccattacgttgaacttggttccgagggcttcgatatcctgttcttttgtttttacgatgaaaggtttgtctttttgtttggctacatcaaagtaggcttccccttccagataaacgatacgttgttttttaccaaagtccttatcgtaatggaatgtcgtttttgatcccaggctgacctgcgtaccgtcgggtaactcaaccacatccgcttccagcccatcgcctccaatatatctggaatataacccattatcaacatctctcgaagaaaagaagaatacagaactgatagctaccgcaatcaaggccacggcaacatagctaccgatttgataccaaagtctgaagctgcgggattgtgaattttcctttttattaagtaaattcagccagctctcatcgatattcagggcttctcctaaagaagtaccggcatcatacatggccttgatctcaaagaatagttccttgttggaaatactctctttcacccaatcgtaaaaaagatctgtttcttctttagacagattgccttgtaaatagcctataattagctctgtatgttcgttttccatgatatctcctttgtatagtcacccttcggtgacttagtcctttatgaacttataacgaatggcagcccaaaagtactcacacaaaaacaaactttttttaaaattaaatacgaacgattgaaaatgaaggcgaatgcgaataggatttaagtaaagccctaggctcaaatcaaggtaaaaagataaaagaaaagatgcgaacaatgcttacggagataaagcaaagacctgtacagctggttctcgactgtgcggacagagaggcccaactgattcgcaatctcggccgctttcatccctttcagataggaaagacggaaaatctcctgattcctttcgggcaactcggcaactttcttcatcaatagatccagcaggtctttccgcataaacagttcgtcggacgactcaaaatagtccagttcctccagtttgagctggacggcccggtgatccagaatttcctgctccatattcgaacggcgcaggtgatcgatacaggcattgcggacagcaacgtaaagaatacgtttcagatcggcatccggaagaaggaagacctgtttgtcccaaagcttgagaaaaacgtcgtgcacgatatcttccgcaaagaaacccgagacgaacttccccgcaaagcgaagcagcatcggagcatattcaagatatatacgctggtagcagtttgtcgtctgatctttcacttccatcttgcaaacatataaaatatcaggtattattccacaacttcgccggcttttaacgcatattacccgctcaaaaatgttcagaagcggaagagcgcccctccaaaggcaacctcaacagtccggcagatattccaggatagtaaggcagatattttcattacaccggcatttattttcagatacctgccgatttatttttcgtccgacaggagtcggacagctgttcgacctatgtaggacagctgtctgagccgggtcgaacagctgtctgacgattgtcaaacaaatattatatcggcacttaagagaaaatacaacggcatccggaaatcctttcaccggcagaaaggtaaatccatcccggtaagaggcaacaggaagacacccaaagtcgtaaaacagaaaaagggcacaagccaatcatgacctgtgccccttttccgtttctttactttacaataaaactatgtacggacggttcatcgaaagtgatggagtcgatcgcacccgtttcggtattgaaatagcggatcgtatccttctccgtattctggagggttactttccagccgtcgccttcccggtcgatcgacaggatatccgttgtgttgctgccgggagatacggccaggccgtcggcacaatgaacggtttcgatatgatagcgccttacatcgagcgggaatttcttcccgttgcaggtgaagttggcggtatgttgcaactcgttgctctgccagtcggtgttcaatagatagatcgtgcggcgatctttattatcccatacggtgaaaccgatggagggggcagactcgatccagccggccttctgttcacctgcgactgttgcttcggcgatttcacgcagggtggcttcatactgatcccgcaatgtattttctgccggataggcatgagcggggaaatagataatctttccgtttccgaaggtaagctcggttttagcggtcagtgtccggtagttttctcccaacatctcacggataacggcatcattcgtagggaagctgacaggctggtccggttgaagctccgcgttcaggtgggcggcagtcaggacaagcgttccgccatcggatacatagttgcggatacgcaggaaatcattctcatcaaagctgttccagccgagaaagaccatcgctttatacttattcattacgtccagaggagcttccaccgggagcaggtcgaccgtaccgtacggagtagcggtaaaccaaccttcgggaccgcaggcatccaccgtattatccggatagaagacattcaggaggtcgaagctttcggtcgccttgttgaatgcccacttatcgcctttctgcgaccacaggctgccacgcccgaacgacttccaggcatcattccttccctggataacggcaatattacttttcagttcaccccgccgggtatgtgtctcgataaaatcgagtacgcgatgctgggcatacagatgctccttacccgacttggaataacggtcgttggcatattcgtccgtccacaaggcttcctcggtatttatgtgggaagaaccgtgcatgtaggcaacggcgagcgacatataaaggcgaagggaatgtttcgggtcggtaaacggtccggacccccattgcatggcatgtagcgaaccgtactgcggcttgctgtaagcccgtgaagcgccacggagggaagaaaggatgatttcttcggggccgtacatctgttcggctcccagccagttgtaccctgcctgatacaaataacggaacagggaagacgggccggtatggcgggtgctttcacctttcgaatagcggaagttctcaaccagcttgcgggctccgtcggccatatctttcacaccctgcggatcgtaatggatgaaaacgccatgatccgtgtaaattggacggtgcttggcaaagatcccgccatagggacggttgcgggcagccatatcggaaaagactccctggtaaaggaaatgctgccagtagtaataaccaccgtcattctcatgcgcctgcttcccccgaaacatgggtgaggccaacgtttcaagatcgggattgatgcgctttgcagccagggtacgtccctcgacctgccacgcatacggcatctgaagcttgttcaacaaagcggtataatgactgatgatctccggattggccacgcggaaaccgctccactggtaagagggacggaactgataccagttaccgatacggtttgagacataccatttaaagaaatagtcgtacggagtgtattccttatcgatatggatctcgtcgcccgaagaaaggtacacctcatcgcgtcccttttgaatgatctggcggatggtggcttccgccttgcgggaaccgtcgtcgaacgtcagcggcacggcagaggcaatcccatcagcacagaactccacgacatgcaaacctgtttccttcagttctacctcctggaatgaaggagttacggaggccggagcctgtatcttgagtttcacatccggtttattcgtttcgagcagaacgccgaaagtgcttccggcagtgacatattcggggacagacacgatttcataatcgcgcgcactctcttctataatctccagcgaacgcagttcataaggataagcagcccggttgtcttctttcaacagagttaacttcaggtcgccctttccactgacggaagcaggcagcaggatatagaagtcggccacatcggatgcccggtcgaagatattaccttcgaagacggtcgtgccgttgtaatccactttccaacgcggccagctacgggtagcgaggttgcaaccgatccagtaattgtaatcgtccggtttatcggcaaacttcgtaaacggaatggaacaaaccggtttcttgttttgcaccagccggggagcttccacccagcattctccgctgaaatgtgtcccgccgatacgcagaaaagcacaagccacattctccggcaggataaacttaccggtgatattccggaacctggatgttccttcggggacactgagataaaggagagagtcgggacggtcgtagatatcatccttataacgccccggtttcttgtagaacagttcgatagccaccccgaagtcgccgccgggagagaccgacaggttctgctgtttgacaacgggcagcgtaacggtcagttcaccggccttcaagagatcgcccgacacacggtaataggcatgacgttcgaagttattgtcttctcccttgaaataaagggaatatttatccttctttacatgaacggagtcgaggttatcgtcgatatagaactcggagcggcggaacatttcctcccccctgttctggaaaggtgccggcatcttcacgccacctaccacgcggaggaatttccgtgtcggataatccgcctgctggaacgagacattctcggtaaggctgttgccgggagttaatagatacaccttctcaccaccggatggggtgaaaacaacggttcgtttctctgtctgcaaaggggtggccagaagaagcgacaccgcaaaaatctgactgaccagaaggtaaaagactcttttcataactaatattaagatatatctgttaatagacaggtcaaatgtacgattaatttccttctttatgtacttttgtctttccattgaacgagcgaaagaaaagaaaaatgatagttatcagagatacggaattattgaaaggaaagaaactggctgccaccatcggcttcttcgacggcgtgcacctgggacacaggttcctgataaatgaactgaaagagaccgcgaaagcccgcaatctgccttcagcagtgatcacattcccggaacatccccgcgccgtattgcatgccgattatcagccgaagttactcaactcttttgatgagaagctggagcagctggcctcgacagggatcgattattgcattgttctcgacttcaccgtcgaactgtcgcgccttacggcacaggagtttatcactaccgtactggccgacaagctgcatgtcgaagtcctgctgatcggctacgaccaccgtttcgggcacgaccggaaagacgggttcgaacagtatgtcacctatggggcggcttgcggcatggatgtcgtcaaagcatccccctatgacgacggacagacggctgtcagctcttccgagatacgcaagttgttaacagagtgccaggtggaaaaagctgataagttactcacttatccgtaccagctacggggaacgatcgtaaacggctacaaggtaggccgcaaactgggatttccgacagccaacatacaggtggacgaaccgttcaagatcgtccccggcatcggagtttatgccgtccgggtctatctgaaaggggaaagatataaaggaatgctttatatcggcgaccgtcccacgctcaacaatggcagcaatatcacactggaagtgaatatactggacttctccggtgacatttacaataacgaaataaccgttgcgtttatatattatgtacgcgaggatatcaagttcggttcgctggaagagttgaaagagcaactggcccgcgaccgggaaacggttaacaaattattatcggaataagatggaactttactacgaagcaatagatacattaaagggaatgatttcccgcccttcctttagccgggatgaagcggcagtagccgattatctgcaacagacctggcagtcggcgggacatacggtgcaccgcaaaggcaacaacctatggatcgtctccccgggtttcgacctgaacaagccgaccctgctgctcaactcccatatcgacactgtcaagccggcctccggttggacgaaagatcctttcaaccccgaagagagtgaagacgaaaaactgtatggcctcggtagtaacgatgccggtgcaagcgtggtttccctctacacaactttcacacagttgatcgggaaagagcaagcttataacctgatcttcctcgcttcctgtgaagaggaagtatccggcaagaacggcctcgaaagtgcgctggccgatctccctccgatcgctttcgcccttgtcggcgaacctaccggaatgcaacccgccgtagccgaaaagggattgatggtactcgactgcgtttctatcggcaaagccggacatgcggcccgcaacgaagggatcaacgcgatcagcctggcgatgaaagatatagaatggttccatacgtaccagttcccggaaaagagtgacttcctcggcccggtgaagatgagcgtaacgatcattcatgccggcacacaacataatgtggtgcccgaccgttgcgaatttaccgtggatatccgcacgaatgaattctatcccaacgagagactgttcgaactgatcaaagagcaggtcggctgcgaagtgaaagcccgtagcttccgcctcaactcgacacggacagcactggatcacccgttcgtcaagcgggctgtgatgatggggaaagaaccgttcggctcgcctaccctgagcgaccaggcgcttatgccgttcccttccgtcaagatcggtccggggaactccgcccgctcacatgcggcagacgaatatatcggtttaatggagatcagggaggcgatcgatacgtatgtgcggttgctggacggactgaaactataagtatatgctgaaaaagatactggggacaattggaacacgctatctgattgcctttctgaacctgatgcttattttcattaatgccaaggcgttgggggtggaaggtgtcggcctggtgggtatcatcctggcttcgataaatattgccgtcgtattcaacggggtcctctcgggtaatacgatcgtgtatttcatgaaccgttattccatccacaccattttgttcccggcttatgcgtggcccctgatcggatcggggctggcgtgcgcttttatgttatttttcggtttattcccggaagagtacctgacagacatatatgtactgtcgctgatatcttctttcattacgaccaatgcccgtttccttctgggtaaagacaggatcacagggttcaacattacctatatgctgcaagggggattgttgttctttatccttctctatttctactacatagccgggaagcaggaagtttcatcctacatctacggattatatatcgcttacggcattgcctttgccggtagcctggtcttgcttttcccctacctgatcaaaagagagaacaagccgacagacaaaccgttcgtttccatcctgaaagagatgttcagttatggcctttggggaagtgcagacaatatagccgaagtgcttaccacccggctgaactatttcctgatccaacgtttcgccggcttgggcagtgtgggattgctggatgccgggacaaagatatcggaaagcgtctggcatatcagtcggagcgtcagtttcatcgagtacagcagcgtggcacaaacgacggatgccgatgtacaaaaaagaacgacattgcagctgttcaagctcactttttgtgccatcgcgtcggcaaccgtctgtattctgtttatcccggaatggatctatacggattatctgttcagtcccgaatttactgggatgcgaaaggttatattcggcttatccgtcgggattgtcgctttagggtgcaacagtatactcagccactatttcatcggaagcgggaagatacgttacagcgcagtcagctcctgtatcggacttctcaccctgcttatagcgggctatatactgatacctctttatggcgttgtcggagcagccatcagttccagcatagcattctgtgccatgctggtgttttccatgactgtgttctgccggcataaccggacccggataagcgaattcatcccagacaaagaagacttcaacgaactcgtcaaacgaatacgcagcaagttcaatacctgaaactacctcctcccaggaactcacgcagaagcgaagtgccgggcaaaccgacatccggaatatagttgaagtaacgaaggaaccgcaacaggcgataagcctccgcattttcagcatcgttttcgcgaacttctgccaggatcggctcggcaaacttgcgaagggcagccagttcatacaacatggcactgttaaacatggcatccgcattctcctgataagggaagatccatttatcttcaccccgacgaacactcggccaacgggcaatcgtgtcctttgccgaataaccacggaagcggtagtcacggatgatacggcgcaacagacggttgtcggtggtcggtatccagttatggttatccaacgagatcgaggtaaggacggagacatagaccatgtacttgaacttatcgtctatcatggcagtcagttcgggattcagggcatggataccttctattaccaagactgaattcttctgcatcttcagtttcttacccttatagatacgcttaccggttccaaaatcgaaagtcggcagatctatttcctttccggataacaaatccttcaactcactgttgaaataaggaaggtcgagggcatagagcgattcgaaatcgtaatcgccggtttcatctttcggcgtatcttcccggttcaggaaatagtcgtcgagcgatatactgaccgggtggatcaggtttgtgatcagttggacttccaggcgtttgcagaaagtcgttttcccggaagacgaagggcctgagatcaatacgatacggactccctcctcataccgcttcgctatttcttccgcgatcttggcgacttgtttctcctgcatggcttccgacaccatgatcagttcggaggtatggccgctctcgatggcacggttcaagtcaccgacattattcaggtccaaggtacgttgcaacgttaaatgctgcttataggcttcgaacatcttatcctgccggatagccggttcgagttccagcggattactttttttgggtatttgaagcaatacgccgtcaaagtaaggcacgatatcgaacagttggatataaccggttgaaggggtcagacatccgtaaaagaagtttatatagccgtccagttcataatacgaagtataaggcatcccggccgtttcgatcaggcgggctttgtcgttcattccacgttcacggaacaggaccgtggcatcgaccgtgcgaaccgtcttatgaaggaaaggcagatcggcatcgattatttcacgcatgcgcttcttgatcttgtcgatcgtttcgatatcgatcttctttccgttatggatcacacagtagtaaccttttgatatcggatgttctaaatttaatgtcgcagaaggaagtacgtcgttcaccgctttggaaaagatatgacacagggaacgaacataagttcgaagccctgaagattgcgtataatccacgaactcaatgtctttcggatgccagcaacggaaattcaaaccctccactttattattcacctgcgcattcatcgggcggtaacgcaaaggcgcacctatcatcgtatagatgtctaacagagaagaaccaatgggaacctctttatagctattgttatttttgcaataaattgtgattgtttcagacatattatatcagttattatttgtagttttgctgcctaaagttaggactattaatcggatatacttccaggtataactatttttttgatggataatacaatttttaccgtactaaagttgctcggttcacttgcgcttttaatgtatggaatgaaagttatgagtgagggtctccagaaactgacaggagatcatcttcgtaatatcctaggcgccatgacgactaaccggttcaccggactgctcacgggcgcgttcgtcaccgcagcagtacagtcatcgacagcaaccactgttatgactgtcagttttgtaaacgcaggacttctaactctgacacaagccatctccgtcatcatgggggccaacattggaacgacgattaccgcttggatcatgtcgatcttcggtttccagttcaatatgaccaacattatctatccactcttcgcgctgtctttaccccttatcttctcccaaaagagtagccgcaaatcattcggtgaattcgtcttcgggttcgcatttatgttcctgggtctgacaaccttgagggagaatgccatgcacatggacctggagcataatcaggcgatcctgtcattcatcacctcctgcaaggaatggggaatgtggtctgtgttgctattcctgctggtcggaagtatcatcacgatggcggtccaatcgtcagcagccgttatggctattacattaatattatgttcgagcggcgtgctcgacctgtacctgggtatcgccctggtgatgggagagaatataggaaccaccgtgacatccaatatagctgcacttaccgctaatgcacaagcccgaagggcggcatttgcccatttcatatttaactttttcggaatcatgtgggtactttgcatcttctatccgttcatagatgcggtcaagagtatcgttacctacctggcaccgaataccccaaaagacatcgccatcacttatacgttgtcggcattccataccgcctttaacatctgcaacgtattattattaatatggtttataaaaccgatcgaacgattggtttgttttgtgatcaaatcgaagccggaagacgaagaatatcgcctgcattatatcaccggcggtctcctgtcgacagccgagttatccatcctgcaagccagtaaggagatatctctttttgcagaacggactacccgcatgttcaacatggtgaaagaggcatattatgaaaaagatgaagacgcttttatgaaaacatacaaccggatcgaaaagtacgaaaatatcagcgaccatatggagatagagatagccaattacctcaccctggtggcagaaggccgtctgagctcggaaagcaaggaggagatccgtatcatgctccgtgccgtatcggaaatcgaaagtatcgccgactcgtgtaacaatctggcacgtaccatcaaacaccggaacgaagggaagtcgatcttcaccgacaaacagaatcacaatatagacaaaatatttgaactggtgacccaggccttgcgccagatgaacctgatattgaagaaaccggaattggtacacgatgatatcaatccttcttacaatatcgaaaacgaaataaacaattatcgtaacctgcttaaacaacataatgtggaagatatcaataataaagcataccagtatcaggacggtgtgtattacatggatatcgtcagtgaagctgaaaagctgggtgattatgtactaaatgttgttcaggcagttattgaaaagaaaatataattatgcatacattcattttaatcggatatttatccacttaaacttagatagatggactattctttttttgattttcttacgcttgtaggagcattaggtatgttcctatacggaatgaaagtgatgagtgaaggtttacagaaagtcgcgggagacaagctacgaggcatcctctcggtcatgacgactaaccgcttcacaggcgtgctgaccgggattctgatcaccgcactcattcagtcatcaagtgctactaccgtaatggttgtcagttttgttaacgcaggacttcttacactgacccaatcaatcagtgttatcatgggagccaacgtcggaacaacagttacggcatggattatctcactcttcggatttaaagtagatatcagcgtcttttccctgccacttatcggtatctgtatcccgttgatattctccggcaaaagtaaacgcaagtcatggggtgagtttctaatgggttttgctttcctcttcatggggttgtcttatctgaaatcatccgttcccgacctgcaaagcaatcctgaaatcctttctttcctacaagattacacctctctgggatatccttccctccttatattccttctcttaggaactattcttacagtcattgtacaatcttcgagtgctaccgtcgctatcacattaatcatgtgtacacagggatggatacctttcgaaatggcagctgccatggtattaggagaaaacatcggaacaactatcacagcaaatattgctgctatctcagccaatgtatcggcccgtcgagcagcgattgcccacctcatgtttaacgtattcggtgtctgttgggtcatggctctgttctatccgttcaccaatatgatttcctggatcgtaacgaactacggccccggtgatccgaacgaaatgacccagttcctcagtacgctcgatccgaaaacgatctcgctgatcacatccagtgcacagattacggacccgcacctgcttgcattacaaaagcaattactgacattgcaggtgtctgtttcctacggtctttccctgttccataccgtattcaatataactaacgtttgtatcatgatctggttcgtaaaattctacgtatacgtttgttcggcccttatcaagccgaagaatgtcagcgacgaggaagagttccagttgaaatatattccttcaggtatgctttctacatccgagttatcattgatgcaggctaaaaaggaaattgccgtattcggcgaacgtacacagcgtatgttcggtatggtcaaagaactgttctacgaaaagaatgaagataacttcctgaagatattcagccgtatcgagaagtatgagaacatcagcgaccgtatggagattgaaatcgccaactacctgacgttcgtagcagaaggccgcctgagttccgaaggtaaagaagagatacgcatcatgttgcgtgctgtaacggaaatagaaagtattgccgacgcatgcaacaacctggcacgtggaatcagacgtcgtaacgaaggtaaatccgagtttacagacggacagaatcacaatatagatcaaatgttcgctctggtggaaaaggcattgacccgcatgaatgaaattctgcatatgcccgaagtggtacacgatgacatcaaccagtcgtacaacatcgagaacgaaataaacaattatcgtaatcagttgaagagccacaacatggaagatgtaaacaataaggtataccattatcaggacggcgtttattacatggaccttatcgccgaatcggaaaaattgggtgattacattctaaatgttgttcaagcagttatcgaaaagaaaatataatcgtatatttgttggtgtaatgaacattaaagtcctgatcttgcacaagatcggggctttttcaatatagaaagaagatgaatcacaaacattatttctgtttcctcctgggatgtttatcaatagttatggcctcctgttcgacagacgatccgaaaccggaccccacactcgacgagaatgtaaatgcttggatctacgatatcatggaaaagcattatatgtggtatgacgaaatcccggcaaaggaatcactcgacatgacaaccgaccccgagaaattcttctaccggttgctttccgataaagacggcaaagtgttaaagggagaaacagagcatcattatttctcaagaatagaaaagaaaaagacttccaccaaatcaatcgacgaagaatcgacatacggttttgaatttgcatcggccgaaatgccgggtacgaaaacaaaagtagcctgggtagtatatatcctccctaattcgcccgcagcagaatcagggttaaagcggggcgactggatcttagctgtaaacagcgaaacacccaacatcaccgacatcagcgtattaagaagtggaagcgctgtcaaattctataccggagcatacaattccacaaacaagaactgggcaatcaccaactctgtcaatatctcagcaagccgcccggtagaaaatactcctttcttaaaagactcggtctatcattacggaaataaacatatcggttatctggcatacaaccatttttcttccggcccggatggttacgaagacaaaacatgggatagacagatgaaacagatatttgcgaacttcaaatcccagaatgtaaacgaattcattctcgatttgcgttataatggaggaggattggtcacttctgcacagttgttaacttccatgcttgcccctgctaaagacctgggtaaaactttctgcaaaatggagtacaatgataaatatgaagataacaacaaaagtttggctttagaatcggccggggctgtatccggagagaatctggacctgaaacggttatatgtgttagtaggccctaattcagcctcagcctccgaggcagttatcaactgcctgatcccatatatgggaagatcgaacattacactgatcggagaacaaacgatcggaaagaccgttggctccgaacaatacggagataaccaggactacgactggttaatatcccctatcgtcctgcatataaagaatgcggatggaaacgcggattacgaagacggcttcgtaccggatatcctgcaggaggaattgtttgtaaacaacactttatacccattaggagatccccacgaattgctgcttaaaactgcatttaaccagattttgaatacaggattgaaaagtactcctactgaaaatacggagcacacaaagatcttctttaatcccatcctgaataaaagaacgaacggaatgttattactcccacaataacagctggaaaatcgacaggcatcggatggggaagcgacaggcacccgttcctcgtccgataggcatccgtttattaaaagataatcagagataaaacagaaaggaaggggctataaacaattaaagcctgtctcacgacaagccctaaccaactttgttaaccttaaatctaatactattatgaaaaaaccacagtacaaagatactgtcgcagcaagcttttgtcaagtcttttacagataatatttgttaagttcgagcgcattcttctcaaaaaaatgttatcgaagacaatatagggttggtttctttgcctaaacaaccctacaccttccacaaatatattaaaaagtcttgaatatgtgcgcattagatagaaagagagatcatgttgtttgctgtacaatttatcgtatatttgccggagtctttaaattgagggcgaaggatgaaaaacgcatttatcaaacttcatatatctatcttactagctggcttcaccggactgtttgggaaactgattaccctgaatgaaggattgttggtctggtatcgcatgatgtttgccgctgttttactgttcaccattctgaaaatcagtaacaagttacaacctatccccctgaaagagcaattgaaaattgccggtacaggttttatactgggcttacattgggtattcttctatggaagtatcaaaatgtcgaatgtttccgttggggtcgtttgcttttcgctggtcggattctttactgctctgctggaacctttgcttattcgtcgcaggtttaagatcaaagagttattattcagtctgatcaccgttgccgggatcttgctcatttttcgatttgacatgcgatatcgttccggtatcataataggtattatctcttcagctttggcagccctattcaccataaccaataaaaaagtaggtgcacatcatccctcccgcatcatgttattgtatgaaatggccggcggttttctgggattgagttgtctattgcctgtatacctgtactttttccctgtcgcaacaatacttccaggcataaatgattttctttatctgcttctattggccctggtctgtacaatcgggctatacctgttacagatacaggtattgaaaacaatatcggcttttaccgtcaacctgagttataatctggaaccggtttacagtatcatccttgccatgttgtttttcggtgaagccaaagagttaaatctcgctttctataccggattgggacttatctgtatctctgtattactgcaaacccgagaagccctcatcaacaaggcaaagtgaaccagaagcgggagcctttaccgggagtggaacttacaccgatatcgccattcagtgctttaatgatggttttgcagatagataaccccagacctgtcccttgtttaaaagagtcgaccttagtaaaccgctcaaaaacagattcaagatatttagccgaaatgcctatcccggtatcacacacctcaaaaagaacatgatcatccttcaatgtgtaggaaagagttatcgttccctgctcggtgaactttattgcattcgacaacaaatttgaaataacctgagtaacacgcttagcatccgtataaagggttatatcaggcaaagcggccaaatcacacaacatagtaaccccttcctgtactttcaggcgatgtacctgaaactcttcactacatatctcttttatactgacttcactcagcgaatactccatcactccggattcaatcttcgaaaaatcaagaatatccgttatcaggcgaagaagcaggtcgcagttcttattgatgatctttacatattcatctttatcttccctggcgtccatttctgcaataattcctgaaaaaccgacaatagcattcaaaggagtacggatctcatggctcatattggccaggaaagtcgacttcagcttatcagcctcacgggctttctgcatttccagttcattcctgcgcgactcatcccgggcttgctgcagtttctcttccagcttcttttcctgtgttatgtcccttatataacaaaccaccttacttggatgaccgtctttgtttatttcatgcgcctgtgcattgatccggacccaaaacggctcagtccccactgccaatttacatacaaaactgcaattgtcggcttctccacgaataacctgtaaaaaagaagacatatcattcgcctcatcttcccccaatttgccaagattacgcaaatcctgaattgacatataattgtatgtcttcatatactcaaataacgggtttgtgctcggaaaatcgttcagtacaggattgatatatagctcatcctcttctacattatattctcctacaatggaacgaccggataacagaacagccttcaggattgccagattattctttgtctgttcagactttatctgggcatccgtattatccgaaataatcattagatatcctacccttccaaattcgggatcatccaggccgatacctttgatttgcaaatactttatatgatcgacaaacgcagaaggataataactggtgttctgtatagcgctgaaatcataaaccaatgggaaactaaagggttgtccgtgctttataccgtcaaggattgaggcagggacagccggattttcaaacaaattaatccccaaaagatctttacgggtagaaccgaatatacgggtatccgcttcattaaggtcgaccagatatccttcagagtcatataactcaactccgacaggcaggttattaaagaattgcttgaattttgtgctgagttccgagagatgctttctcgattcttccagactactttgcgtttgcaggcgttcgattataatagagaagatccgggcaataatatgtaaatcttcgacatcttccaacgtccaggaacgttgaacccggacagagtcgaaaccgataaagccttgtacctgattatgaaatgagagtgggataataagcatggatttgagatgctgcaactcaaacaatgtcttatcgatattggcttccggcggcaactcgttcatactgcacaccacaatatcatgtccggactttatcgtgtccattatccatggaatcgtttcatatgtaagttcggaatgatcttctttcggcacctcgacccatttgctcatcacttcgcacgggaaactcgccatttgaccattatctgcaaaaatagccacatatccccagtcagcattgaaaaagtcgagaagtaatctcattgctttctctatcggttgttcctcttcgttaaatagcaagacaagcacctccgatataatacgctttatagcagggaagccggaagaagaactatttacatctatctgttccttgtcccgtatttccaataattgtattagctcttctctggatagctgactatatttactcttagttagcgttgatgtcatatagggtaactttacaaacgcaaaaatatggaatagttttgatttttaaggcatttcaagaaattaattacaggagaggcatgttaaaattgaaagataaccatcagtcaaacagtttctttagaacaattatgtttttaatcataagtctgttcggcgtaaaaagttatatttgcatgttctaaagtagacgattttaaatatgttgaagcaacagttacaacaaaagttacagcaaaagctctctccgcagcagatacagctaatccggcttctcgagcttcccgctatcgagctggaagaacgtatcaagcatgagctggaagacaaccctgccctggaagaaggaaaagatattgcagacgactttgaacggactgacgatgaaggtggtgatgatatatctacaaacgagacagaggcagacatctcgctcggtgattatatgaccgaagacgacattcccgattacaaactacgtgaaataagcgaaaaaacagaacgcaaagaagatattcctttctccgtaagccaatcgttaaacgaatacctattacaacaactcggattacgcgacctgcccgaaaagcaggtaaagatagccgagtacataataggaaatatagacgatgacggctatcttcgccgcgaactttccgccatagccgacgacctggtattccaggccggacaagatgtagacgaaaaagaaatagaagaagtacttgccatcatacaagacttcgacccagccggagtcggagcacgcaacctgcaggaatgcctgttattgcagctcaaccgaaaagaaccgactgccggagtagaaatggccgtccatatccttacggaatatttcgaagaattcacccgcaagcactacgacaagatcatgcggggactgaacatcagtgaagagaccctgaagagagccatccacgaaataattgccctcgatcctaaaccttgtagcagctggggcggttctatggaagtagccatgagccaggtgatccccgatttcctggtggaagctatcaacggagaactgatcttaagcatgaataaccgggacatccccgacctgcggatcagtcgtgattatgcggaaatgtttcaggactatgccggcaacaaggcaaaccagacatccaagatgcgcgaagccgtacagttcgtaaagcagaaacttgactcggcccagtggtttatcgacgcgatcaggcaacgccaggagacattacaacgcacgatggaggccatcatccttctgcaacgggattttttcctgaccggagacgatgccaccctgcgcccgatgatactgaaagatgtggccgaacgtgcaggatacgatatatcgaccatttcgagggttagtaacagtaagtatgtacaaaccaacttcggtatctaccctctgaagttcttcttttccgagtcgatgcagaccgacagcggcgaggagatttccacccgtgaagtgaagaagattatgaaagaacatattgaaagcgaggataaacgtaaacccctcaccgacgaggaactcaccaccatcctgaaggagaaaggatatgttatcgcccgccgaacagtggctaaataccgtgaacagttagatattccggttgcaaggctcagaaaagaaatataaatttgaagcgtatgagactgttttcaaatataatatccggtatgttccacccgttgctgatggtaacgtatggagttatactggcactgacatttacatatcttgccatctatccccccaccatgaaactgtttctggtaggcggcgcgttcctatctacagctgtagtaccgggacttttcatttatctgatggtgaagaacggggcagccggcgatctggaactgaccgaccgcaaggaaagagtcgttccttacctgatcatcatcacctctatgatggtctgtattttctacatgtataagatgatgatacccttctggttcctgtccctattgatgggagcctgcgtagccttgctgatatccctgttgatcaacttttactggaagatcagtgcacatacgctgggagtcggaggactattgggaggcatgatggggattgcccgtctccaccttataaatccgtactggggtttcattatcgtgctcctggcagccggtctggtcggtacatcgcgtatctttttaaaacgtcacacaccaatgcaggtgtatgccggcttttgtctgggatttatatgtacctttgtagcctcattattgagttatatctatttattcatctaataaaaacactaaaattatgaactttcctgctgatttaaagtacacaaaagatcacgaatggattcgtgtagacggtgcagtagcctatgttggtatcactgattacgctcagagcgaattgggcgaaatcgtttttgtagacattactacagaaggcgaaaagcttgacaaagaagaagttttcggtacaatcgaagccgtaaagactgtttccgacctgttcatgcctgttagcggagaagtaatccaggctaactctgaactggatgacaagcccgaactggtaaacgaagatgtttacggaaacggctggttgatcaagatctccctgacagatccttctgagctggacgatctattgtctgctgctgaatacgaacaattgatcgctaaataaatgacacctgtagttagtattatcatgggcagtacttccgacctgcccgtaatggaaaaagcggccaaattgctcgacgagatggaaatcccgttcgaaatgcatgctttgtctgcccaccgtactccggctgaagtagaagcctttgccaaaggcgctaaagaccgtggtatcaaagttattatcgctgctgccggaatggctgcacacctgtgtggagtgatcgcatcgatgactaccctgccggtaatcggcgtccccatcaactcgacactcgacggtatggacgccctattggctatcgtacagatgcctccgggtattcctgttgccacagtaggtatcaacggtgcattgaacgcaggtatcctggccgttcagatgctggctgtaggagacgaacaacttcagggcaaactggctaattacaaagaagacctgaagaaaaagatcgtaaaagccaacgaagagttagctcaggtatcttttaaatacaaaacaaattaatcagattgccgggataagacgtttcagcaactgagggtaaccattcccctctcgagagggggcagggggtgtgttaaagccagtcacaagacgaacctgtaacacatcccttatcccctctctagaggggaaacagatacaaccggtcgctcttcctgttatccccaaaacaaactagtaaatggatcattttaattacagtcgccgcaaatcgtctgctgtcaatatagggaacacaccgctgggaggcgacaatccgatacgtatccaatccatggcaaatgtttcgaccatggacaccgaagccgccgtccgccaggccatccgcatgatcgaagcgggagccgaatatgtgcgtttcacagcccagggcgaacgtgaagcccgtaacctgggagaaatccgcaaagaactaactgcccagggatataccaccccgctggttgccgatatccacttcaaccccaaagcagccgatgctgccgcagcagaggtagaaaaagtgcgcatcaacccgggtaactacgttgacaaagtaaagaccttcgatcttctggaatataccgacgaagaatatgccgcagagttacagaagatacgcgaccgttttgttccctttctcaatatctgtaaagaacacggtaccgccatccgcattggcgtaaatcatggttcactgtccgaccgcatcatgagccggtacggtgacacccccgaaggaatggtagcctcctgcatggagttcctgcgtatctgccgggacgagaacttccctgacgtagtcatatcgatcaaggcttccaacaccgtcgtaatggtcaaaaccgtacgcctgctcgttcagacgatggatgctgaagatatgcattacccgcttcacctgggagtaacagaggccggcgacggagaagacggccgtatcaaaagcgctgtcggtatcggaaccctgctgacagacggcataggcgacacgatccgcgtctccctcagcgaagacccggaagcagaaatgccggtggcccgtaaactggtcgactatatcctcgaacgccagggccataagcctatcaatgccaatatcgctcccggctacgacccgataacagcctcccgccgcatcagccgcgtaacggaaggtatcggaggcaattttcctcctatcgttatctccgaccgcagtaatggcgactttgaattcgaccatttgtcgatgccggactatatttatatcggcaaggaagatcctgaaaaccttcccgacaatttccgcatgctggtagacgcccatttctggaaagaacgtccgaatgcattcccttacttcatagcctctgaaatagaagaaataaagaacttcaactctccactgaagtttatacggttgacgtacaacgacctgacaagccgtacattggagatactgaaacaagatccgaccatcgtagtcgtactaagtacccaccaccggaatggtgtcggctcccaacgcgccgcgatgcataaactgatgatagccggctgcgacgtcccggtcgtccttcaccgcgaataccacgaaacggacaaagagtcgctgcaactgaaatcggccgccgatttcggaaccctgttgctcgacggtttcgagggcggtataatgctgcaaaacgatgagtgcgaagccactgttacagacagttgtatgttcggtatcctgcaggccacccgctcacgtatcagcaaaacagaatatatctcctgccccagctgcggacgtacgctttacgacctgcagaccaccatcgctcgtatcaaggaagcgacctcgcacctgaagggcctgaagatcggtatcatgggatgtatcgtaaacggtcccggtgaaatggccgatgccgactacggttacgttggtgcaggacgcggacagatcagcctttataaaggtaaagaatgcgtattgaagaacgtcgccgaagaagatgcagtagaacgtttagttcagttaataaaagagaacggagactggcagaactgatatttgtactatcttcgtccctcaaaatcaagatataataatggaagtaaagataattaacaagtcacatcacccgctacccggttacgcgaccgaattatcggcaggtatggatattcgtgcaaatctgacagaacccgtcgtactgaaaccgctggaacgtaaactgatcccgacagggctctacatcgccctcccggaaggatacgaagcgcagatgcgtccccgcagcggcctggcactaaaacatggcatcaccctgttgaatacaccggggacgatcgatgcggactatcgtggcgaaatcgggattatactggtcaacctctcttccgaaccgttcactgtaaatgacggggaacgtatctgccagatggtgatcgccacctacaaccaggtaagttggaaaccggtagaagtgctcgacgatacggaacggggagccggaggtttcggacatacgggtaagcagtaacatgcaaacgaatgcgcacctgttgcgcattaccgtgcgcattggtataaatatagaaatatcagatatatgttgaagcaattaatatacgggatactcttttcattcttcctacttacgggcattcaaccgttgcatgcaggagaggtaaagaaagacactccctcaaagccgaacgaactaagcgcaaccgaacagaggaaattcgactatttcttttttgaagggttgaacctgaagactgccggaaaattcgatgccgccttcgatgcatttaaccattgcctcgcaatcgactctaccgcatccccggtgttgtacgaactttcctctttctacatacagttgaaccgcccggaaaaggctgtcgacatgctgaaacgcgccgtagcgaacagtgccgacaacttcacttaccgtatggcactagccactatctcccgcaacctcggtatgtacggagaagctgccgaagaatatgagaagttgctcaaagcctatcccggcaaaccggaactcaactattacctggcagaagcccttacacaggaaggtgagatcggagaggcgatcgatgcctacaacgccctcgaatcgtcgataggtatgaatgaagccctttccatgcaaaagtacaaactctacaaccagttggagcaatcggatgctgccttcaaggagatagagaagctggctgccaaatacccgatggaagcccgttaccagatcatcctgggtgatcttcacctggaaaagaacgatacggtaaaggcccgctcttactatgacaaagcgcaccagattgatccgggtaatccttactacatcgtttccatggcaaactactacgaagctaccggcaacaaagaggctgctgaagaacaaatacgtaccgccctggtgaacgagaaactggatgtagacaccaaagtcggtatcctctcccgttatatcctgaaacagcaacaaacacagaaagataccaacagctccaacgctctcttccagactttgctggaacagcatccggaagacaccgaactgaaacagatgtacggtagcctcctgttgtcgcagggaaagaccgacgaagcacgtttccagttccagctcattaccgaaatggaacccgaaaacgccggagcctggcaacagcttctcaacatgtcgttgaaagcggaagatataccggaagtgatccgcatctgtaccaaatgccaagagctgtttccggacgctcccgaatattatttctacctgggtatcgcttattaccagcaggagaaatatcaggaagccctgaacacttactatgccggtatcggcatcatcccagcggagaacccgcgcctgaaatcagacttttacggtcagatcggcgacatctactaccagatgaagcagatggaccagacctataaagcatacgatgaagcattgaagtacaacgaaaacaatattgtcgtcctcaacaattacgcctacttcctttccctcgacaagaaagacctgaaaaaggcggaacgcatgagtgctcaatgcatcaagctcgaaccggacaatgccacttatctcgatacctacgcctggatattcttcgtgcagggcaactatacccttgccaagatctatatcgaaagcgccctggaaaaagataagacaaaaagcgccgaactggtagaccactatggcgacatcctttacatgacaggagataaggacaaagccgtcgaacagtggaaaaaagcccgtgaactgggcaaagaaagcgaagtactcgaccgcaagataatcgaaggcaaatatatcgaagaggaggtcaagaatgaataaaacacgagaacgaatagccctgggtatcatcttatgttgcattgtattcctttccggctgtaaatcttcaaagaagatcggtacagtcgtgtcgggaggtgccaaggcgcataacgaattcttcgaactgatggaagaacatgcttttcagttcaataccctgacggcccgactgaatgcagagcttaaaatgtcgaagaacaacatgagctcgcgtgttgacctgaagatggtccgcgacagtgccttccagttatccgtacagccttttctggggatagaggtattccgtgccgaatttaccgtggacagcatcaaggtaatcgaccggatgaacaaacgctatgtagccgaacgttatgccgacctgaaaggacaaaccccgatcgagtttaatttctataacctgcaggcgttgtttaccaatcgtatatttttgcccggccatcaggagatcgagccgaaacagttcaagcggttcaagctgaaccaggacggggacaaagccgagatcaaggtaaaagatgctatcggattgctctataccttctttgccgacggcgaggagaagttgctttccacctacataacagatccgtccgaacaatacgccctgcaatgggactatgccgatttccgcgtgacggacggacaaccgttcccacaattgatggacgtaaatgtactgtcaaacggctcgtcacaaggcggtgtcgccttccgtttctcccgtatacagacaaatgtgccggttaatctagattttgctattcctgctaaatataatcgtatcacctttgcacaaatcataaagtcaatcagtaacagtcagaaatagagatgaaatatatttggattgtcatattcacgttatccgccctgactgccttcggccagaagtccgcacgagtgaaacagcttgaagaacagcgtaagaaagcgctggctgaaatcgaaatgacaaaccagttactgaaagagactacccagacagcccaaaactccctcaaccgcctgaacctgctctcacagcagattctttcccgtaagaaagttatcagtctgttgaaccaggaagtcggcgagattgacaaccagatcgccgccgcccgccgcgagatcaaccggctggaaaaggagttgggtgagaaacgtaccaactacggaaaatcagcacaaagcctgtataaacgccgcagttcgcaagacaaactactgttcatcctctctgccgacaatttcgcccagtccatgcgtcgcatgcgttacctgcgcgaatattccgactggcaaaaaaaacaggctacggagatcatcgacaaacaaaccgagatcaacctgaaacagcgggaactggaaaagacccgcgccgaaaagaatgctttgttgggaacgcgagaacaggaaagccagaagcttcagaccgaagaaagtagccagaaagtagaggtacaggagcttaacaaaaaacaaaaacagctgaaagacgagcttcggaagaagcagcaacaggccaacgccctgaaccgtcagatcgaacaacagatcgccgaagaaatagcccgtgccgaagccgaagcaaaggcagctcgcgaacgtgaacgccgtgcccgtgaaaaagccaatgcaaaggctaaagccgaaggaaaagaaccggtacaagagccgatacgcgaagaacgtgtagccgagactaaaggaggttacgctatgaccaaggcagaaaagaaactgtccgacgatttcgccagcaaccgtggacgcctgccgttccccgtatcagggcgctatactattgtcggaacctttggcgaacaacagcattcggaactgaaatacgtccgtaccaacaacagcggtatcgatatccagactacaccgggaaccgatgcccgtgcgatattcaacggcgaagtaacccgtgtattcgtagtgcccggctataacaattcagtgatcgtccgccacggtaactacctgaccgtttacagtaacctgagccaggtatacgtaaaagccggcgacaaggtcagcacccgccaggccatcggtaagatattcaccgatacggaagccggaaacgctaccatccttcatttccagctttggaaagagaaaacgaaactcaatccgacaccgtggcttgactaatgctttaacctattttaggcgcaccgactcgccaccggcaccgagataatcttgctgccattggcgaggttggctaaataccgttagcgagacaagctcgtcggtgttagtgagggtcagtcgctgtattttactttttcatttcaattaactacctttgtcatcgactttaataagtatgattatgtattggacgctttttcttactttcctcaaaatcggtgtgggtacaataggtggcggatatgccatgctaccgttgatacagcgggaagtcgtagaccgcggctggctatccaaagaagatttcatcgacctcttttccgttgcacagtccctgccgggtatcttcgctgtgaatatatccatctttgtaggctataaactgaagaaaaacatgggaagcgtggtttgtgcactgggtacgatcctgccgtctttccttattatcctactgatcgctacattctttacccaggtgcaggacaacgaatgggtagagaagatattcaaaggattgcgtccggctgtcgtggcattgatagcagttccctgtattactacggcacgatccatcaagctcaactacctgacaatgattatccctattgcagcagctctgcttatttggatgggaggtatctcaccggtatggatcatcttggtagccattgccggaggattagtgtatggtttaaagataaagaagaattgatatgatttggttacagttactttacgtttatctgaagatcggtatcttcggttttggtggcggatatgccatgctttcactgatacaggcagatgtagtagaccgttacaaatggatttctttacaggagttcacggacattgtagctatctcccagatgacgccgggcccgatcggtatcaacagtgccacttatatcggttacacggccattcataacgcgggatactcgcctgttatggcagtcctgggctcatgcctgactacgttcgccgtctgtctgccttcgttcatcctggtattggtcatttcctatttctttgccaagttcaagaacaacaaatacgtcgttgccgctttcacaggcttgcgccctgcaacagtcggactgatagccgcggccgcattaatgttgatgaacaaagaaaacttcatcgactacaaaagcttcctgatctttggtgccgcctttatcctcacttggaaattcaaagttcatccgattctgatgatcgcactggccgggattgcagggctgatattatattggtaaaacatgctacttttgcaaatatatgccttatatttgcaaaagcagttcataaactaacaggctatggaaacaagaataacattaaaactgaataactccgttgttgaaaaagcgaaagagtatgcacgttcgcataacataagcctttcaacaatggttgaacgttatttgaaagcaatggtatcagataatgatattccttccggacaaatagaaatatctccccgtgtaaaagagttgagtggtgttataaagctcccggaaaactatgattacaaacaagactacggagactatttagaaaagaaatatcaatgaagaatatatttttagataccaacattgccatagatctcctgtcccaacgggaaccattctattcgacagcagttcccatctttacaatgggagatactggtatcatccgtttgtacatctcttctctttctttttctaccatattttacctcttacgtaaacaagttggctccctaaaagcaatggaattgctttgcagtttcagacaaatggtacacgtcgtttccgtaaacgaaaaggtaatcgatatggcactgcaatcttctttttctgattttgaagatgctgtccaatactactccgctatcgaaagtggcattccggttattattacgcgaaatgtgaaagatttcaaaggagtagacgcatcggtcatgacaccggaagaatacctaaaagcattaaagaaataaaaggtgaaacattctggaattgtttaaggagttcttgcaattcttctacgacgaaagcccctgcaggaaatcctgcaagggctttgttttttatctatgttctctcttcgcagggatactgatagatgaactttattttattactttagtattaatacggccacttgttcgcccatcgcggggtaattggttggagtatagacgttgcaagcaacgcctatacctgacaaccgcgtagcggcaattttagaattattttgattataaattattttacgattgctttaacagcagcttcaccttcaacagctactacaactacaccggcaggagtagcgatagttgcattgtcggaagaaatcactgtgtttgcgattgcctgaccaagaacgttgctgatagtaaccttcttaccctgagcaccgttgatgataactgcaccgttagtagcaactacagatacttcagaagcagaaatagcatcgtttgaagtcggagcttcgtcagttgcctcgatgttgaagatttcagcatcgcggatagcatcttcataagaagtatagttagcaacaacaggtacaccgttcttaacagccacccaagcaccttcgcctgcactaggaatcttcttgtcaccttctgtttcgatcaggaagtcagcagcatccgtatttaccagacgtaatgcaaatacagcattcttgataccattcttatgagtagcgtggatagaatcaccctttgaagtagcatcagacaatgccaatgtttcctggttatgtttgttatcacctaagaagatagaatcacctgacaagtggctaacctgaccgttacgatagattaccaaagtatcgccaatatgttttgcatctacaaaacctaaacgagtatatcttgagttccagatataatctttaccagcacccttaggcaatgctacagagtcagcaaagttaaccaggtagcgacctgttgtataagcttctgtcttaacagcatgcggacaatgatctacaccattagcttctttccatgcatccgtattgtgttcttcgtcgaacggacaattccaaccggcttcgtggcgaactgcacccattacgaacatgtactgaggcattgttgtattcttacgtacataagcagtatcgatagtcatagcagcctttgcagcgtcgcccttaccttctatacccaggaagttgatacctttatccttagaatatacagagtttgcatcttcatacagatattccttagcagtagagttaacacggaagatcttagcaacgttaagatccatatccttcaattcatctgtttctaaagtcttacccagacgacgatacaacggagtagtatcttctgtcaaagcaaatgaagatgtacggcaattcaaatcaccataattacaacacaaacattcctgtattaattgagcagtaacatcatctacaccaactttatatgactcgatcagagaagcagatttcaaagaactcggctgagcggcatctgcttcaatcagcgcataataatgtgtgccatccacacaattctgttctttcagatagaagatagtagcatcggctctctttgccagaatatatttcacgctacctccataataatgagctgtaacgaatctcttttctgagtcagtcagtacgcttgagttttcaacttccagtttgtaagctactttcttcaggtcatttttataaccatacttttcagctacatacttttcttcgttatctgaatttacaggaaccaaagagaaagcaacaccttcctgaccaacagtcagtacaacattgtcgctggtagtatccaaacctacctgcaagttagcaccttcagcagccagaccgctcagataagtaagattgtaagttttttgttctgcaatatcggctgttgtattttcattgaaataaccatattcagtagtcggatcgatcaggttaaatacgaataccataccgttatagtaatattcattcgctgctaaaccttctcttttaacgaactgatggataccttcattgtaaaaaccaaaaccatttccaaattctcggttcatgatcttaaccgggctaacagaagccatagttccattcttgatcactttctcaactacccattggtaagccggcatgtgctcaacgtcttgtttaacaacttctgagaaattaaattcaccacataagctgttagaagcatacaaacctacataaggtttataatactttacatcagtagatttcacatatactttgtaaataccttccggaagagttgtataatccttgcttacaccatcataagccagtaaattaaccaagttctttgttctgttgccatcgcaagaatagaaagtgataactttttgctgttcatcaaccaatttacaatgagacaggatcaggttttcaccggcaccattctgtacatcagctgctacttttttagcatcaacagcaggccatatcttcgtagcttcagcatctactgtattcgcatagctccatgatgtataagcattcttatctttattattataaacagtaggttcacctgcttctctatccatttctacagcttcaaccatagtctgcacccagattgagtcgttagccaggttctttgtaaatttgaaacggaaagcatccaaaggaagaccttttgcgatctgtttaaaacattgagtatagccagaaaccattgaagctgccttatctgttacaccgatcttattatacattttataagtagcaccggcacttgcaaaataagaagtatcgacatgcaggtatttattagaaacttgatcgttttccaatgtactcaggataacatattcagcactttcagtaaaaccttctgcaaatccagctgatttatcaatattgtaaacgaaatcatctgcatctgttgctgcatcttcgacgttaagctgttgagcctgcaacggagtggcaaaaatattgttttcttttgcatcactaccaaagtcaagctgcatataggctacattcttagtattggtcttcgtattcaagtcttcagcactcaaaacataagtaccagctttaacaagcttcaatgccaatgccgttacatcaggagtcttatcgttagcatatttgtaagcatatacgctaccatttttattagatcccaaaatcattgtagagtctgcatttgaaaaaacaacgctcagtggagtttctgtttcaaaagcttcaccagcgtatttgctttcaaaccatttccagttaggataagcaccaccaatataggtagactcttctgttactttagttgtcttagttgcattagccggatcaaatgagaagaaaagacctgttgctttgtttaccaggcagaaacgagttgtaccaccatcttcagaaatctgaggtttgatgctccacaaagcctgattaatttcttccaagctcctaagatcaccaactaattgtgcttgaaaagctgtattcgaattatctaaatatagatacttcccatcggcatcttgtataaagtaatacaagttctcgttcacactctcctttgcttcgaaagaagcaccggttaaaccggcaggagcaccgcataatgagggtgtcactcccccctgagcctgaactgcgcctacacatacggccagtaagctaccagccaaaaacgtagaaatctttttgttcataaatctaaattttaatattaataatagtgttaatgaaatagttcctgttcgatgttttgaatgtcctttttaccaaatgactagagaaaacgatcgttttttctagtcatgatttttggcctcatttactttcgtaattgaaacatcgttttttgtactaactttgctattcggttgataagaaatgagataggaatgataattattttatgaaaaggattgctggtatgaaaagaatgtctaaatttgctggcgataaaaaacgatcgttttttctagtcactgtttttatatcatactccccgcattaaatcaaggttttcgtacaattttcacccctataaaaaagggttgtttttggcatccctgcctatccgtaaaaaatggctgcctacccgtcggaagcccgatgcctactcgttttcgagccgatgcctacccgttggggaaaaaggcgttttttcggaggcaaatgttaaaagcttcaaaagcaccaaaagcctcttagggtatctgcggtacgggaacggcctttcccgctgtcgttttctgaaaataaccggctcctaatgaaactattaacttatttttctcggttgccagaagaagacggtcgaccgacgatttactgatttcgcgcacggtgccctcttcgcggatctccgcccgcttaaaacgttcgggcatttcggcaaaaagcttctgcaaagtgaaaggcatcttataatgcaggttcttcttactctttttcaaggaagtgctcaccaggtaagtatgttgcagacaaaccgtgccgatatggaaagcagcattgaaatcatcatccgagatcacccaatccttttcttcactcttgctctcccccttacgtatggcagtcagtaccataccgatacggaagatagccaaccggtaacgcaacacagcggaagccacatcctcgtgcccgaacatacgtacattattatattcatctttgaaataagcattcaaccgctcgcgctgtgcgcggctgaaacgtacctaggttggatacttatccagatgtacgccgatatccaacacccgttcggccaacccgtcgaagtaatgcgcggccgcaggcgtatcgtcttccgaggtaagcggacggtattcgccatgcccggcaatcttgtacatcatcaaacggctgaacaatccgctctcggcggaagggatcagccggctgaacatgcccggcgtaccggtcaacagcatactgagcaaaggataggaagccagcagcgaaccgttcgtctttgtcgagttgcctacccgttcgtgatgggccgcctggttcaacagatagccgtagttgccgtaatcctgaaacagggtattggtgacggcctctatctcggtttcaaacaggcaggaagcataatgttcgttcgtttccaactgttccaccatccgcgcgagcgaggtataaccggagacgttcaagtccatctgtttcaccggatcgggattttcgggagccaacccaacgggtttctttccgcccgaacggagcaactgcttctgataaaggtcgtaatcctcctttttcttcaggtattccttcacgcggtaacgcgaattatcgtacacgtaacgttgccaggaggcgatcaacttgaagagagccgccacacagcccttgccgcttcccgactcgccaatcaccacgccatagaaaggagcctggtattctttcctggcaaacgaaccgagcacgcggggcgtcacgctgctcaacaaggccagcgacgacaaaagcaatatgctccgctcggtatcgtcggacgcatattccaggatttcgaggacaagcggcggcagcgactgcaaaaactctttccggaaagggggaagagatgtttcatccggctctatatcaatgccttcaccctcctgttcctccacggtttcatttccggcattaccggtgaagtctttggggcttttgaggctttgcgacgttttcccgtcggccggagggcagtaagggttggagccgtgggagctacggtagcgggcgtaaatatcggtgactatggaagtgatctctttttccgtgaagtccgcccgggtgtaacggcgccggcattcgtcggccacttcgcgctcgtcgaaaccggcattgttcaacacagacgccagtttgaccatataggcatggcggttgcccgaaatgaaggagttgccggcctcgaacttttccaggtaatgttccaggcggttgtccgataaagtattatcggccggcggtgccttcgcggcaatatgcacgacagcagcttgtgccttatagaaggcagcggggtcggcactgacaaagcagctccggttgggatctttgccggagatatcgacttcgacccccggcaggtcggtttctatccggtgccgcacggtttcgaacgcctgcaaatgctgcggcaggccgctgtcgaccagcacaaacagcttgactcctgtaccggatgcgctgatgtgcccggccttcacgtagggtagctccccggcacgccggaggatatcggtagcggagcctgccaccttgtcgatatcgacagtgatgcactggctgtaactcaccataaactcctgtttgcgaccgccttccataacgccgccggccacgacgagcgggaggttcttcttccgcccgtcgccgcttttcttatcgcctgcggcataagcggcccgcaggagggagataggggataggtattttccacttttcacctgatcaatgtattgatccaaagagatagcctgatggctgcgtgtgtcgaatgcagagtggaagaaggtacattcgacgctttgttttgagaattcattcatgatacgggttgtaaggcagcgagggtacaccgccgttaatactagtgataagatcgccgggatctatgcattaaggttcgcccaggtggtcgatcagtaccgccacctgcctgggtgtgtagagtttctgaaacttcacccagccggctgcttccagtttggctttcaggccgcgtgaggtacgtatccattcccacatgcgcttataagccaccacaggggtgcgaccggggaaatataactgggcgaattcggcaacaccataagcccttttgaaattattttttccatcacaaacagtatccatacacgttgtatttaagcgtttaacaatgatataaatatagcaaataatacaataacaggcaagcaaaaaccaagttattttcacaatttcaccccaccccgttaaacctttttatcgcccctttgtctatattccgattgagttgtgtatatttacatgcctattgataagttttaaagtagataccattgaaaatatgacgaagagagtgaagtggggcgttaccgccgcaatccttctattgattgtaggaatgattgtttatccacagattaagacccagttgactgcatccggcaaaacggacgaagtggctcccgctccgggaacgagcttacggaagcaggtattgaacattaacgccgaagtgctgaaattccaatcactgaccgacaaagttattagcacgggcagtattatccccgacgaagaagtagacttatccttcgagtcgtcaggaaaagtagtgaatatctatttcaccgagggtacgcatgtgaaagcaggcgacctgttggcgaaaatcaacgacaaacctttacaggcccagttgagaaaactggaagcccagatccccctggcaaaagaccgggtgtaccgccaacgcacacttcttgaaaaagatgccgtcagccaggaggcttacgagcaggtgactaccgaatatgagaaactgatggccgatatcgacctggtgaaagccaacatcctgcaaacagagctacgcgctccgttcgacgggatcatcgggctgcgctcggtcagcgaaggggcctatgtctctcccactaccgttatcaccaaattgacgaagatatcgccgctgaaaatcgagttctccattccggaaaactatgcgaccgacgtaaccgacggtacttccatcgtcttccgcctagaagactccaacggtatgatgcgcgattacagcgccaaagtatatgccgtggaaagcaaggtggatatgtcgacccgtaccctgaaagtgcgtgccacctaccccaacaccaacgagtcgatcttccccggacgttatacctcggtggagatcaccaaacgcgaaataaaagatgcattggctatcccgagcgaagcgctgatccccgaaatgggaaagaatgtggtctacctgtataagaacggagtagccgaaccggcggaaatcacgatcgggctgcgtacggaaagccgtgtgcaggtacttaaaggtgtacagcccggcgatacattgatcaccaccggtgtaatgcagcttcgtaccggtatgcaagttactattgataatctgtattaaattcccctatggcaaatatatcggaaaccagtataaacaggccggtactttcgacagtaatgatgctcgtcatcctgctgttcggtatgatcggctacaagttcctgggggttcgcgagttccccagtgtagaccagcctattatctcggtaaacgtatcctatccgggagcgaatgccgaggttatcatgaaccagatcacggagccgttggaacagaatatcaacggtatcccgggtatccgttctctgagcagcgtcagcagccagggtagcagccgtatcaccgtcgagttcgaattgtcggtggatatggaaacggcagccaacgacgtgcgcgacaaggtatcgcgtgcccagcgctatctgccgcgcgactgcgaccctcctaccgtatcgaaggccgatgccgacgcatcgcccatcatgcagatcggtatccagagtagcaggcgttcgctgatggaattgagcgagatcgccgagttgacggtaaaagagcgtttgcagacgatctcgaatgtgagcggggtggatatctggggacagaaacgttactccatgcgcctgtggctcgacccgatcaagatggcgggttatggtgtcacaccattggacgtgaagaatgcggtggatgcggaaaacgtagagttgccctccggtagtatcgaaggaaatacgatcgatctttccatccgcacactcggattgatgcatacggccaaagaattcgacgacctgatcatcaaggaggacggtaataatatcgtccgtttcaaggatgtgggacgggcggaactggccccggaagacctccgcagtattctgcgtaaaaacggcgaaccaatggtgatcgacgtaatcatcccccagccgggagccaaccatatcgaaattgccgacgaggcttacagacgtatcgaacagctgaagaaagaccttccggaggatgtgacgatcgaaatgatatacgacaatacccgtttcatccgcgcctccatcgccgaggtggaagagacgatctatgtggcattcgcactggtggtattgatcatcttcctgttcctgcgcgactggcgtgtgacgctggtgccgtgtgtggtaattccggtttcccttgtcggggctttctttgtgatgtatatatccggcttctccatcaacgtattgaccatgttggccgtcgtgctctcggtaggattggtggtggacgatgcgattgttgtcgcggagaatatttatgtccgtatcgaaaaggggatgagtccgaaagaggcgggtatagaagggtctaaggaaatattttttgcggtagtatccactacgatcaccctgatctccgtattccttccgatcgtatttatggaagggatgaccggacgtctgttcaaggagttcagtatcgtgattgcaggttccgtggcgatttcctcatttgtcgccctgacttttacccctatgctcgcaaccaagctgctgcgcaggcgggaaaagaagaactggctgtatgtgaaaaccgaacctttcttcgaagggttgaataatatctatgcccggtcgctcaattatttcctgagccataaatggtgggcgatccccatcgtggtgatcctgttcggttcgatcgggtatttctggaaaacgatccggtcggaattgtcaccgctggaagaccgttcgtccatctcgatcaatatgcgtgcacaggaaggggctaccttcgagtttatccgagattattccgaccggatagcggaactggccgactctatcgcacccgagcgtaagttcctgaccaaccgttcgtcgagcagtaacgcaaatatcagcgtgatcctgccggacatcaaagaacgcgaacgttcgcagatggaaatagccgagcatctttcggcggcggtaaggaaagagacacaggcccgtgcattcgtacagcagcagtccactttcggaggacgccgcggtggtatgcctgtgcagtatgtattgcaggcacccagcctggagaaactggcggaacacctgccggctttcatgctgaaggtaaacgaaagtcccgtattccagatggcggacgtgaacctgaagttcaccaagccggaaacgcgtatcgagatcgaccgcgacaaggcttcttcattgggagtaagtacccgtaacatcgcccagacattgcagtatgcgttgagcggacagcgtatgggctatttctatatgaacggtaaacagtatcagatattgggagagatcaaccgtcagcagcgtaacacgccgctcgacctgaaatccatctatgtacgtagcgacaacggggatatgatccagctggataacctcgtcgccctgcatgaagatgtggcgccgccgcagttgtaccgctacaaccgctttgtgtcggcaacggtttccagtggtctgaacaaaggatatacgattggcgacggtctggacgaaatggaccgtatcgcgtctgaaacattggacaacagtttccgtacggctctttcgggcgagtcgaaagagtttcgcgagagttcatccagtttgatgttcgccatgatcctggctttgttgatgatctacctggtgcttgccgcccagttcgagagtttcaaagatccgctggtggtgatgttcaccgtgccgctggccattgccggggcgttgatgtttatgagttactcgggcatcacaatgaatatattcagtcagatcggtatcattatgttgatcggcctggtggcgaagaacggtatcctgatcgtggagtttgccaaccaacgccaggaggcggggctgagtatggcggaagcgatccgttcggcatcgacacagcgtctgcgtccgatcctgatgacaagcgtgtctaccatcctcggattggttccgctggtatatgcgacgggcgaaggggcacagggacgtattgcgatgggtgtcgccgtagtaggcggtatgttagtttcgacattccttaccttgtttatcgttccggcaatgtatagttttatctcaacagacagagcaaaaaagatatgaaaagattggcaataatcatactggcagcatctgctaccctgggtgtaaaggcgcaggaagtatacagcctcagacaatgtatcgaaacgggactggaacgcaactactccatccgcatcatacgaaacgaacaacagattagcgacaacaacgctacgccgggtaatgccggttatctgcctaccgtggatatgagcggcgggttcagcggctcggtgaacaacaaccgtaacaagctgaccgacggcaccaccgaaaagcaaaacggcgtcaacagcgaaaccggcaacataggcctgaacgtgaactggaccgtattcgacggcttcggcatacaagccgagtattcgcgcttgaaagagttacagcggatgggcgaactgaacacccgcatgacgatagaggatttcgtggcagacctttccagtgagtattacaaccgtatccgccagaatatccgtctgcgtaacctgcgttcttccctcgatctttcccgcgaacgtgtccgtatcgcggaagagaggtatcatatcggttccggctcacgcatggacttgcaacaggcacaggtcgacttcaactccgacagttcgaaggttttaaaccagctggaggtggtcaacacctcgcgcatccggcttaatgagctgatggcactcgaaaatgtagaggagaacatcgctatcaaagactcggtgatctatccgaatatcttcctggatgaagtggagctatggaaaagcacgatagaatcgaacgcctcgctcctaattgcacagaaaaacaaaacgctctccgaactggattacaaaaaggttaaaagccgcaactacccctacgtaaaactgaatgccggctatggctacaccgccaactggtatgaggtggggagcaccgacctgcaacaacgcctgggcctcaattacggcataaccgtcgggctgagtctgttcgacggattgaaccgccgccgcgaacgccgcaacgcccgcatcgagatcgagaacaaggagctacggatgcaggaactggaactggccttgcgtgcggatatgagtaacctctggatggcttaccagaataacctcgacctgtggagcctggaaaaggaaaacctggtcgtcgcacaagagaactaccgtattgccatcgaccggtacaaattgggtgagctttcgggtatcgaactgcgtgaagcgcaaaacagcttgttggaagcggaagagcgccagtccatcgccgaatactccaccaagctatgcgaagtatctttgctgcaactgagcgggcagatactgacttatgtggctccggaaccggaaaaagctagtttttaactacttttggcttgatccaaaagtagacaaaagatcaaggctacaccggcttcgctgctacggcaaaagactacgctgtcgtctgcgaacgtaggatgcggagtagcgagacaggtgctgccttgaacttttgattacttttctttcaagagaaaagtaattttaatattacgtgctacatacgcctcattgccggctgcatccgtgcaatagaccatcaggtgataatttccttctgttgcgttggccggtatctctatgtcatggtgatggatatgcgtattcttctggcctgatacatcccatgaccggttaaatgcaaaagcgaccgtctcgcctgtcgccgccttcgtatgttcgtgcccgtcgaagttattgtgtatctcgaccttataagagccaagcatcacattatccgacagatccatttcaaaatgaatggaagagcccggcttcaacatcgctccctcttcgggttcgatcaggttgatgaccggctttgtcgtgtcgccgtccttttcatcgtccgaacaagatacaaacaaggcagctactgccagaatactaactatcgatagataaaatgctgttttcatttgagtaattttttaaatggaatctttattaataactggaagttacgtcccggctccgggatctctaccttccgataaaaactgaggtgattgtaatatttcgtattcagtaaattccgggcagacagagtaacctctatatccgtcccgctcataggaatacggaagccggcacccagatgcaacaattgcgcacccggcgtggggtcttcattccgggctacccggttctgatcggctatatactgatgctccacataaaaacgcatccgtttcttctcccacgaaagcgtgttccgcagggaacccgggggagagaaactaagcggtatatgttcgtcgcagttgtaggtgtagacatactcacctcccaattcataactgagatgcaacggcagatcgacctttgccgaaagttccccaccggcaaaaagagcctcggctcccgtatagcggtaaatctgcccggcatgtggaagtacggaccattcgccggtcggcttcaaatagatatagttgctgaaccaactgacaaacggagaaaaggtaaccgaaaagaactttccaaagaaggaataagccatatccagctgccagccccgttcggagtccaggttcgggtcgccctgctcatgccggaaagtgccgtgatgcaccccgttggaggccagctcgttcgctcccggcaaacggaaactatgccctacattgactttcaccagatgctccctggccggcgaccagaccacacccaacgaagcggagtaatcgccgaacctcctgtctaccgcatggctgcgtaccttattcccgtcgatgactgcctggtcgtaaccttgctcttgaagataagtagccagataagcatccgtgaaagggctgatatccgttttacctatatcataacgcagtccgccgctgacagacaatacatccgtcggtttataagtagtcagccaggagaagcctgttgtaaaacgagtatattccggcagcaggaacgagtaccccgaaatggtattccgctggtactgcaagtcccagccggcgctatgatcccaaacctgagaaccggtaagccgcactttcactcccgaactgaacgtattcaaggtaaaagccaactctttgtccggatctatgtcgggcacaggctgcgtgccgtaatgggtatggaacaagctccattcctcccggtggttattctggtatcccagatcccactgaagcaatagcttctcccaggcatactcctgatgggtagtcaccttcaggtgattgacaaaactgtaaggcagctcgatgttccgcgagctaccgtcgtcctccacccgcaacggatcgggaatgccgtgagcacccggaaagaaaccgaccttctgataagcattgctgaccgcataatttcccatataaccgttcttccggtattgggtaaataagctcgcatcacgctcgaagccggccgtattcttcaaccggcggttatatacaggaatcttctgagtcaggtagttgatcgtatccgtcgggatacggtaatcgccgaaatgctgttccgaataacgcagcttcgtgaaccaacggtctttcttcacacccagcatcagggagccgccgaacagcccgttgaccgactttcccagcaaatccacctcaccgaacacctggtcgtcaaacggaggcgccgtctgggtaatctcgaccaccccgcccatcgcatcactcccgtacaggagcgaagccggccctttccttatgttaacctgttctacattgaaagcatctatttcaagcccgtggtcggctccccactgctggccctcctgcttgataccgttctccgtcaccgataccctgttgaagcccataccacgaatcaccggtttcgaaaaaccggaaccgatatccatcgaatgaaccccgggaagctgttccagggtctgcatcagattgccggagaaatgctcttttagaaattctttcccaaccacatccaaatggagtgtcgtattcttgttccgcagatactggtagttttcagtaaccacaatctcggaaagcgacacacttcggagcgagtcgggatcttgggcatgaagggtacctatacagcataccaccagcatacccggaattattccgatacgcataagttgacaattgaaaattgataattataaattgaaaattaacgggatgccgaatggcatctgtcaacaacaggcaggcggagcacggagattaggtgaataagaaagctgaaaaaccttcttacccgggaaagtaatacgctcgacaggactgagcgcaagtataaaatgtaaatcaagtgaatgcgattcgaggaacggcgaaaggaagaaattacaaatcagacagtggtcggggttttgagaatgttcttccccttcatcggcatgcgaagcagtgcagcaagtcacctctttcagttcatgcctatgcgcgatcttcacgacgaagaacggaagcatgaccaaaagcaataaccacgccaggaatacctgttttcttctttctgccttcacaatgggtctgttggagtgataaataatccttattgccacgacaaatatatagatattctctttcccgctgtaatcattagatgctaattattgccaataaacaagaatatcttacttttgtgtggcaaatacaaataagaaatgcagatcatacccaaagctaataccttacgcaaaagcgtactcttataccggggcatacggtaccgccgcggttacggggtgcattcgcctttcgtcttcaatctgataacgaaggtgatcgaggaacgttgttcgtattatagcttttacgatatagagctgatccggaaacagcttcttttccggaacgatatcattacctatccggacaggcaacagaaagggaaactgcgccgccgtacgatcggagaaatagtggaacgcgaagcgatcaagcccaaacacggggcattgctcttccggttaaccaactatttcaagtcacggaatatactgcaactgggtccgtcgatgggattatccaccctctacctgacctcctatgcacccggattaaaatgtatcgccctggaaaatgtaccggagttcgcgcctatcgcccggatcgcttacgaaaaaggggctcacaacccgatcgacctgcgtaccggaacaaacaatgaactgcttcctcaagcgctggaagaactaaaacaggtagattttgtattttttaatagcttatatgaacaacataataacgtttggttgtttaatgaatgtattaagtatgcacacgacggctcagtctttgtctttgagggcatcaaagccagtcgtaaaatgagggaattttggaaagaagtctgtacgcatccggaagtgacaataacgatcgacctctattcgatgggtatcgtattctttaataagaaattgcataaacgcgattatattgtttacttctgacggcggtactgtaagggcggttcgcgaaccgcccctgccaacgacactatattaagaatatcgaataaaaaaagaagtatatgaagaaaagtattatttataccggtggcggtgataagggcaaaacatccctcgtaggaggccaacgggtatcaaaggcgcaccagcgcatagaaagttatggtacggtggatgagctgaactcattcatcggattgcttatcaccgccctcgacgaccaggcggatatcgattttctttcttttatccagcataaactgtttaccatcggttcttacctggctaccgaccaggaaacgaccgagctgaaaatagaaagcaaagtcacccccgaaagcatcacccgtatcgaacgtgaaatagaccgcttggacagtgagttgccccagatgagaaatttcatcctgcccggaggaagccgttcggcctcgctggcacatgtctgccgtaccgtctgccgtcgcgcagagcgccagatctatcgcctggccgaaacaaatccggtggaagagcctgtacttattttcatgaacagactatctgattatctgtttgttctggcccggaaagagtgtataaagaataatggcaaagaaattatttgggattatacttgcaactaagaaatattgttttatttttgcggaaaaaatgagaacctgactgtcttcggacagttgttaatactagacaactatgtattggacattagagttagcttcaaaactggaagacgcaccctggcctgcaaccaaggacgagttgattgattatgcacaacgttccggtgcgccactggaagtgattgaaaatttgcaggaaatggaagacgaaggcgagatctacgaatgtatggaagacatctggcctgactatccaagtaaagaagactttttcttcaacgaagaagaatattgatgtgctgtaaacacaacgtattgaaataaaagcgaggtagtgggccttcaaggttccctgcctcgtttgtttttttgcgataaatacaatttatgcctttttgctgcgttattgtaggggtgaaacctatttcgccacgttagttatagtttaaatgaagagagtcttcttgtttattattgcattgattacctgtacggccggcgtgcgggcccaggacgatgtgcagttaagccagtactttttgggcatgggatattacaaccccgcctatgccggaacgacaggagacttgaacatgctcggcttcttccgccagcaatggatcggcatgccccaggcgggaacttccttcttcgtgatcgccgatatgccgctgacgttcggaaaaacaaaccacggcgtaggactggttgtcaatacggaaagtatcgggcttttcacgaatacaaaagtcgccgtccaatatgcctacaaacagaagctgttcggaggaacattaagcatcggattgcagggaggtatattcaacaaaggtttcgacgggacaaaagtatatatccctgaaagcgattatcaccagcaggaagacgaagcaatcccccgcaccgcagtacaggccatggccctcgacgtaaatgccggtgtttactacacacacaagaatttttacgtcggtttcggagctacccacctgacagcaccggagatgcagttcgaagaaaatgcttatacatacctctctaccggattaaatttgacaggtggatacaatattcaatttaataatccgttgtatgaattacagccttctgtattcctgaagacggacatgcagacgttccaggcggatatcaccgcccggatggtatataataaaatgtttaacggaggtctttcctggcgtgtgaatgaatcggtagtagtattattgggagccacattcggcagattgcaagtcggatatgcttacgacttccctaccacggcgatattaaaggcaagtaccggcagccacgaggtggtggtaaggtatcagttgaagttgaagaagacaaaaacaggaaagaacagacataaaagtgtacgtatattatagtatatgaaaaaagtattattagtacttatggcagtagccttgcttacctcatgcggtaaatccctttccggagcgggaggagaagttaccggggtacggtcagtggcttttaatgaaccctcgccttatggcatggttctgatcaaaagaggttcgttcgaaatgggaccggcagacaaagactcgttgtgggggatcaatcctgaaacaaaaggggtttctttcgatgccttctggatggacgaaacagaaataaccaatgccaaataccgtcagtttgtctactgggtacgcgactctatcatccgcgaacgcctggccgaccctgcttatggtggcaacgacctgttcaagatcaccgaagaccggtatggcgaacccgtgactccgcatctggactggagccgtccgatcccctggaaacgggcgaacgaagacgagttgcgcgctatcgaaagcgtatactacgtacatccgatcaccggagagaaacgtctggacgaaaagcagatggtctataaatacgaatggtacgactatacatcggccgcccttcgcaagaatcgcctagatccgggcgaacgcgtgcgcaacaccgacatccaggttaacccgaacgagatcgtaacaatctcgaaagatacggcctacatcgacgatgacggtaatatcatcaacgaaacccttacccgtccgctcagcggcccctgggatttcctccatacccgcatcgtaaatatttatcccgacgaaacctgctggataaacgacttcaacaatgcttacaacgagccatacatgcgtatgtacttccagcacccgggatacgacgattatcccgtagtaggtgtctcctgggaacaggctaccgctttctgcgtatggcgtacagatatgttcaaacaatccctgaacttcccgtccggacaggccatcgagccgttccgcttgccgacagaaggcgaatgggaatatgcggcacgtgccggaaagaacgagaacaaatacccctgggcaaccgacgaattgcagaacgccaaaggctgtttcatggcaaacttcaagcccggaaaaggaaactatacggaagacggacacctgatcccttcacgggtaggttcattcgctccgaacgaattcggcctgtatgacatggccggtaacgtggcggaatggacatccaccatgtattcggaatcgggcccgagccagatgagcgacatgaatccggacctgcgctacaatgcagccaaggaagacccgtatgccatgaaaaagaaggtggtacgcggcggttcatggaaggatgtagcacagtttatccgttcggatatgcgcacattcgagttccagaacgaaacacgttcgtacatcggtttccgttgcgcacgtacacaagtcgggttctcccgttcaaaaggaaagaagtaataacgtaggggcggggtctgcccgccctcttaaaaatagaaacatacaacattatgggaaaatatagaagatataaaaacagaatagagatgttcctttccagcgacatgggaaagagagtactgaacttctgttacagctggggagcatctatcgttattatcggtgctatgttcaagttgctgcacctgccgtacggtaaccagatcctgtttatcgccatgacggtagaagcactggtattctttatctctgccttcgaacacccttcaaacgaatatcactgggaagaagtattcccggttctgaaatcaaagaacccgatggaccgtcccgacttcgcaggcacaggtgttgccggcctgatcaactcggaagacaacctggaagacgataattccggcaaaggcatcaacataaacgtcggcgcggcaaagaaagcagctatcgcaggcgacctgggaggagcttccgtactgagtaacctcgatgtcagcgaagaagacacaaagaacctgagcgaaagcatcaagaaactgagcggtgcagccgaacagatctccaagatggccgaactgaccgaagctacccagaagtatctggaacaattgtcgggcatgtccgaaaacatggaacgtttcagccatgtcaccaactcgctgaccgatgtttcagacacattgcttaactcatataagagtatcaccgacaattcggacggtatcaaccagaactcacgcggttacgtacagcagatggaaaacctcaaccgcaatatctccggtttgaacactatctacgaaatacaattgaaaagtatcagttcacagatcgaatcgatcgaacatatcaacggcggcctgaaccgtatccgcgaaatgtacgacggctcggtaaccgacagctcggtcttccgcaacgaaacggaaaagatgacccgccagctggctgaactgaatcaggtatacagccgcttgctgcaagccatgactgtcaatatgggtggcgcccctgcttatcagcaaccggctccgcagccccaacagccacagcctgcttaccagcaaccgacagcctatcagcagccgtaccagcaaccgtacgggtatcagcaacaggctccgtatacaaacaatcccggccagcaacaagccggtagataacaaacaaacgaaactgaagaaaaatgtctggaatagcaaataatcccaactcgccccgtcagaagatgatcaacctgatgtatctggtgttcatcgcgatgatggcactgaatgtgtcgtcggaggttctcgatggtttcgagttagtggaagacagtttacgaacgtctatcgataactcgtcccaccgaaacgatatcgtgtccggcgaactggctgcctattaccaaagtaaccccgaaaaggtgaaagaatggtacgacaaaggcaagcaggtcaagacggcttccgacagcctgtataactatgtacaggaactgaaagagcgtatcgcagtcattgccgacggaaagaatgccgacgtaaataagatcgaccataaagacgacctcgaagccgcttcacgtgtcatgctggcaccggtcaccggtgaaggcaagaagctgcgcgaagctatcgactcttatcgttccatgatgggagaaatggtggaagataccgccaagacccgtgtcctggaagcgagcctgagcacaacccctccccacaaagccggtatcaatacccgcacatgggaagaggccctgtttgaaaatatgccggtagcggctgccgttactttattgaccaagctgcaaagcgatatccgttatgcggaaggtgaagtactgaataacctgttgaacagcgtcgatgtaggcgactatcgtgtgaaccagatgacggcacaggtcatcccggaaagccagatcgttatgcgcggaggccagtacaaggcaaacatcgtcctgtcggctgtcgactctacgaaacgtccgaccgtatttgtcaacggtaaagaactgccggccgaaagccgcggtcagttcactactatcgcaggagccccgggaacttatcctatcaagggatatatcgaaatgccgaacaatgacggcagcataatgcgtcagaacttcgaaagcgaatatttcgtgaccgaaccgagtgccaccgttgcaccgctattgatgaacgtattatatgccggtatcgccaacgatatgcgtattgccgtaccgggtgtaccgagcggaaacataacagctaccatgacaaacggaaccctgacccgcaaaggcgatatctgggaagcccgtccgtcgaaagtaggaaccgacgccgttatatccgtcaacgcacgcatggccgacggccgcagtgtggaaatggcaaagaacaccttccgtgtacgtgccctgcccgacccgatgccatacatcgagtataaagaccagaacggcaacgttcgtaagttccgcggaggcaacatgaccaagcgtaacctggtcgaaacagaagtcctgcaggctgctatcgatgacgatatattgaatatcaagtttgacgtattacgtttcgaactgttgttcttcgactctatgggaaatgcaattcccgaggtatcccagggcccccggttctcggatggtcagaaagacagaatacgtcgtttaacaagaggcaaacgctttttcataagaggtgtagtagccaaaggccccgatggtctggaacgtaccctcacaccgatcgaagtcattgtaaattaaatgtaggggcggtccgtgaaccgtcccaaataaggatataaaatatgaaacgtttttattacatactggcaattgcaagcgctctgttcttcacagccacctcgattcaggggcaggaagaaacaagcaacacccagcaacgggcaagaagaagcccgcaggccacccgcggagaacgggcttctgataaaaaagacaccggtattcccgaactgaccgtacgggcacaggatatgaacgagcgtatgacacaggaagtgggtaacgcccggtggatgcgtgtcatgctacgtcagatagacctgatgaaagaaaagaacgctccgctgtattatccggttactccgatgaacggacagatgaaccttttctccatcatcttcagtctgatcagcgaaggtaaaatagatgcgtaccagtatgaggacggttacgaagatttcagcgaaggcaataagatagacctgaaaaagatgctcgacagcttcggcatctattacgaagaggttcccggaagaggaactgaaggaactacattcgtcatcaacgaaagcgacataccttctgaaaccgttcgtagttattacgtaaaagaggcttggtatttcgatcagaataactccgtcttcgatgtaaagacactggctatctgtccgatcatgacaagttcgggtgatgtgggtgaagtcaccatgccgatgttctgggttccttacgaaagtatccgtccgtatatcaacaccgcattcatcatgacgtccaacatcaacaatgccatgacgttcaccatcgatgattatttccgccgccgtatgttcgaaggagatatcatcaagacacaaaacctgatgaacctgccgttgcaggcttattgccctactccggactcattgaagagagagcaggatcgcatcgaaggccaactggtagcctttgaaaagtctctctggttccagcccgacacaacccgggtagaagacccgaaagctgctaaaaaggcaaccaaagcctcagcccgcggacagaaaggagccactaccgaaaaggcagtcaaagaaaagacagtcaagacaaaagctccgaaagcccaaaactcctctccggttcgtagcgtgcgtcgcagaagataaaaaaagatactcccttccatagtgtcgggagtaccttttcccctctcgagagggggcagggggtgtgttagaacatcctcaacaaccagctccccgcagcataaatcatcaacgcgtatccggctgtgacggcaagctgctgccggagctctcccctgaaccgcttccgtaccccgagagtgtcaacaacgccccgatgcaggccaggacgatttcggtacggtccgcccacgaggccgtcatccccagtatcaccaggtaccacacgagccacttccggctgattgtccggcatagccacttcttcttttttcccatctgtctccttctttttaaggttcaacaaaaagcccaacagggccctgataaattgcaggatttgtcttagtttgttcattgttgttgattgtttgttattatcaattgtaagagtcacagttattatcagaaatgaatgtcgtgtcgtaggtaggggcggttcgcgaaccgcccttacaggcgccgtcataacggaacaggtaggttcgaccgtaggggcggggtctgcccgcccttcttcaccggttgttatattattgtcgcaaagggcgggcaaaccccgcccctacaaaacctgtcatttgggttcaatattttctaacttcacgccacctccccctgtacccaatcatacatatctcttaaagaggccaccttttgggtaatagctaccaggttacggcgatactgttcacggttatcaccgttctgttcagagatgtaagggctgtaagcgatctctttggcataagcatcggggcgctgactgaaactccaggcacgcgggtaaccggtaaagatcaagcgggcaaaatcgaggaaagaaagctccggagaggcataatgccggaaacggagtgttccgtgcgggccttttacatccgtcactgctccataccaatagtcattcgcagcaccgtagcccatgatcccgaaatagttatgatgttccgttgccagggaagaagtaccccacccgctttcgagcgcaccctgcgccagaatgaccagcgggttcatgtgaaacacttgtccggccttttcggcagccggcaggcaactccgtaaataatgtatctgcttatccataattgatcgctttttagttgtatatcaatataataattcgtatatttattctgttcaaaccttcaaatacaaaccgtatggaaaattcattcaatcagaacagagtatggggctggggcgagcttgccctccaatattttcctaacatatcacagaaaagtgcaacaatgcaactactgaaatgggtacgcgtaagcgacaagctcgtcagccagttagagtcgtcaggatggcatccccgtaagaaataccttacgcccaggcaaaaagactatatcgtagaacacctgggcgaaccctgaagcaggaaggaacaatagctattcgattaccggacggtcgtcttcaccatcgcctcctccttcctcttccttcttctcagacgggtcgggaatacgttcgaatgcatagttattcatcgactctctcaataccttaccgggtcgaaacacgatccgcttacttttgatcagcgcctggttgaactcctttttcgtctgcgttcctgtactgccgaactgcaactggaaactacccagttcgcccacctgtacgatctcccctttccccaggctacgcttcatcacattgaccagttcgtccagaatcaacttcacatccccggaagaggccgtcgaagtcatcgagatcaggtcacacaattcatacacgtcgcatacacccgccgccttcgcattggcataatacaactgactcccttccacagcatccttgcgcaggtccttacgcaacaccaatttgtactttgctggcataatcattcaaatttaaagttaaacatcctgtttattaatcacataacaaagatacgaccaccccttcccgcccggaggaaaggggcggaaagacagagaataagtggaaagacagggagagataaggaataaacgcctataggaaagtgatcggggaaaacacgcccggaatataaaaataccctataaggtaacccaagctaccctataaggtatcagactttcccctataccctgttgcaagtctccctatatggtaaaacgctggacatcaggagatatgaaaagtttaggacagaaaaggacaaaaaggacaccgacacagttttcagacagacacccgttttcagacagccccgcagccaccgttcaggcagcgggcgggaggttcttacggtaaacgccggcagagaggcgggtgatatacagcggttccaaacgggaaagatggcgtcgtacggtacggtcgtttatccgggcggcctggctcagggtataaagttccgagagggtgaaccgctcgggcaattgttcgaatatctgccggaaataatcgggacaggtaagctcctggatctgagaggcttcttccagctgtgtcatcaacaggcggctgtgttcgaggcagacatccacgatcgacagggcagcatgaaaatgggcggcactgcaataccgctcgtctaccccataatcgagcgaagctgcatcgagcgccgtaaagagcatgcagagacggtaggctatcaatccgtgacgcttcaccacactcaggaaatggtcgctaccgaaaagatcggtttcacgcaacaggcaactgaaatgcacattcagttcctgccattgctgcggggtgagccgcacctgcaggcggcgtttacgcaacaacaaggccatatccagcacccgttcggaaagcgtacccagatggagctcgaattcccgcgcatcgccggccgacgaaacatcctgccacacggcttcgctacggcaggtgtacaacagcagacggctcaccaggccattttcgacatccggcaccagacgggagaattgtcccggcgtgccggccagcaagatagccaggcgcggatgttcgatacggatcatttcgttatcggtcttacgcgacgaggccacaggttcgtgatgaaaggccttgcgcaacagatcgtcgaacaggccgtaatcctgcttaccggcacttatcagggtgtcgatctcactgtcggccatcagtgcccccaagtcgccgttttcggccaggtgaaccaatagcttcgccttggtgatctgggtaggaataaagaaatagcaggtggatgctttctgcggggcatcggccacccggaccgcctttttcgtgcggcgcgattccgctttcttcaactcccactcttcgagggcctgcaggtagtcttgctccttgcgcccggtttccgtctcgatcagtgaagcgtagcggtcggccagacgtcgcatatcgttgatacaacctttgccgttggcagcaggggcaatctcgacggtatagagatggggatagacgcgcttgcggttatatacgccccacacgccgggcagacaggcactgagcacggtgcaggccgccagcagggccatgtcgcgttcgcggggatcggtgtagaaacggagggcatcgcccagcagcgggggaagctgcgaggtgatattttcagggagaaaaggggtacgacggcgaagctcctcacctgaaattgtgccggtgtcctttttgtccttttctgtcctaaacccggcaggagccgccgagtattcgggtttattcccctcatacgcagaggataacgcactttttatttcttcggccgagaagtcggaggcttgcaacagggggatgcaaaaagccgccgtttcatccagcgggaagcccttccggttggcttcgcagccgaggcggtagaccgtctggttgcggttgccttccgccatcggatgacgggccagccattcctcaacaaagagctgcacgggtgaaagggaggcgacagtgaagacctccgcctccggattataccaggcctccggatcatcgctcacatagcaacaacggcagatgtctttgcagacacggtcgcacgccagtcccgacagctgttcgtaataggcagccacagcggtaaaggcattgatatgcatttcgcggtcggtatccacccgcacgaacactttcagtccttcgccaccggggctgacgaacaatcccagtgtgtacttctgtgcccgaaagagggcagccaacccggaagggtcggccacatggtcgaagtcgagccctgtaacccgggagtaaatctccaactggtcggcccgatgaccgcgacgaaacacccccgaaggggtgaaaccaggcaactgtcctttcagctttcgggcttcttccttacgtccttcagccagggcggcacggtaagcggttatctcatgcatccaacggcgggtgcggatcaggataatgatctcttccaatgaacgggattctgatgcaggtaaatacaatttgtgaaaaaaggaaacagcgggtgttgtattcataataaattgttttatggcaactaggccggtttagttgtctacaagatacccaattccatacttgccaccaagcatacgaaatgaccgcttccggcactccccaacacaacgcaaaggctgtataacaggccttgcagcaatggtttcctgccaaaaacggtcgatcggtatgcggaagggggaaaaatttatttcccgaatctttcggcatcttccgacatatagtaataacgctccacggtagcggcatcgacctcaaagtcgaagatggcatacatcaggcgataaaggcggccatcagggtgtgctccggcactttccttcaacatccggtcgatgtgtttcattccgaaagcgacctgctgatgtcgaccgacgggtacgggctgacggtcttcaggataaatcactgcagccccgaggcgttcggccaggagcttcttatagcttttcagcttccgttcgttactacgcgacaatttgccgtcgttttgtttcacctggcgcaaccgttcgatctcgccatgcagtgcatccagtgaaagggatgcaggggtttgttgttttttttcatttggaagtaattgatgtaattattatcaaatacgaaaccccggaagacgaatcccccggggcttgtttttgtctgttgttgctcttcacagagatcgaacagaagaactttatttcattactttagtattaatactgaccgcttattcacccatcgcgggctaattagttgattcaagtacaggcatcaaccgcgcagtcaatttaaatttattgattataaatagtttcttattttacgattgctttaacagctgcttcgccttctacggctactactactacgcctgcaggtgcagagattgtagcgttatcagaagagattactgtgttagctactgtctggccaagaacgttagtgattgtaacagtcttgccttcggcacccttgatgatgactgcacctgtagttgctactaccgatacttcagacgttgtgataccttcgttggcaaccggatttctggtttcgtcttcgttcaaattgaagatgtcaccggcatcttttccttcttctaccactaccgtaccgttgatccatttcaggtaacctgtgttagatacaacatcctttacatccaggtcaccgtttttccagttctttctctgagtctggatcttgaatgttccggctgcataatctacataatggaatgcgaacttagcaatgttgaaatcaggtgttcccaattcaagttttacgtattcgccgttgttacgttggatatacaatgtatcgttcaggtggtaaccgtctacgaatgccaacttagcacgtacttcgccggcttcgtttttgtcgatatacgggttgttgctatgcaggtgttttgcttcgtatacatttgccgtatccatcaggttaatcaggaagcggcctttcagataatgactcttcactgcatccggacatggtttgccgttgttgtgttcgtctctccaagcctgcgtgttgtgttccgggttaagcggacaaacagcgtcggttacttctgctgcattcactgccaacagatactggtagcgagtgttttcaccgccttcacggtttacataagcggtatctacgaagatagccgggttgatcttactgaactgatttacgttgtcgatatttaggaagctaggagcctggccttctaccaatacgcttgcgtcacgtttttcgtacagaacctgtgagtcgttttcttcacgatagatacggattgtatcacccatcgataccttacggtattcaggtacgttaagaacttgtactttcatcaggtcattaccctttacagagtagtttgcaacgttgttcaacaggttcgttgagctacctgcgtagatcttattgctaaacggattgccataaggagctacagtattatctgagtttttaatgtccctatccagcgttacgaaatgatatgtgctgtcgggacgcatcttcaatgcgaaacgagtagctttggcttctaccttgttcttatcgcagatatagaaatcgcctgcttccaaagactcgtcgttatacttcacatattcgctgttggcagcattctggaacagatacggaaggattgccaaggtgtcgggaacagaagttacctgatcattcttgataatgcttacattactgattacaagaacggtgtcgatcacagcatctttcactgttttaccgtcaaccgtccaatcttttttgtcgatagacagattccattcgccggcattgtctacattaccatccataccgatcttatgggttccctggttttcagcccaatacatctgctgagttacatttcctacctggtttaatgcgctcaggtggtaacgttcgttgcgcaactgattttctttggctaccatgaaaccatcaaacttgttgatgtctttcacgtatgacaagcggatcgtgtctctgtaagatacttcttttccgctagcgtcggttacctcatacacagactctacagaatatacatccggagtatcggtagtatacagattcaactttcctgttttaacagtcggctgttcacggtttgtcaaaacgatcttaccgtcttcaccagagatagcccactgagtttcaggagaacttgctaatacttctgtttccagagcagcataacccatttccatatcaccatcgctatccaaacctacgatcgaaactttaccgaaacgatccagattaccattagcacctgttactttcttcgtatttgcataatggatattaacgaagcggccacccttaaccaagtctttaatcttagctgttttgctgcttccggctactacataaggatatacatctgaatctgctttgccttttgttgttgtcaagaagtattcaccgtttacttcggcgatgtacaagcgggttggatttataaagctcccatcaccagacgtcacttcaacgatcaaatccttactatcggaacctgagtcgtgagaaatacggaaccttgagcaatatttatccgcgtagccgtttggacgcatcatctctttctcagtaagaagagcaaacttgtaacctctctcatatgtccccttaccattcagatcactactttctgtaccccaagtctcactacctgcaacaacgtcacgtagtaaaacaacatacttaccttctgctgttttcagtctatacccatcacttacatcaactgccgtcaacttacctgcaaacgcttcagcacccttgatcgtggcattcttatcttttgccacatcgatagtcaagctgaaaccgccaccttctatactgttcaactcttcagcagtgtaagctttggcaggagcttcgtaaagtccccaggtagcagctacaacatcaacagcgtcagtagtaggaacaccaccttttgcattaaccggtttattctctttgttcagcaatacaaaaccattgttgtactttccatcattttgaacagtaaagaattcaccagccaagttcagggtatgaccgactttgttcttgaattgataactgcatgctccggttgatgaaatagatgtttctgttactttccaaagagcatcgtctatagaagaggcaccagaaaatactgtcaaaatcgttccatcataaactacagagcccgtcccattcgccgacagcaaataataagtatctttattaatgctggataccaatttctgaccggataagttttcctttgccggattggttattgcagataatgtattaacaacttcgccatacgtatttgttccactcattaaagtaggagtcggaccactaaagacgaaagaaaactcagaacctgattcagctacaccccaagaagcggtagcagcagcctttgttggcgccggcgtcaccgttaattgacaagccttttcttttgctctggataatgccaaagaggtatatttaccatcttttaatgtccatgaataagcctctgccgtattggttgtaggagcaacttctgtttctactacggctttatctttaatcatcaggtatttacctgccacctgaagataagtaggagtgtcgattgcttttgtatcaactgttacattgacagtcttaccgtctgctgcgatctccacatctacaccaggcagtataggctgttcgcctgcagctgcttctgtttgccagaaagcgatttcgacaacgccatcggtagtttcatcacttgggtcagcagtaatcagcttaacagcaccgtcagctaaagaaagttctttagtggcagtatgcaattcgccaccggctgtataagaagtgaagacaacagcgtctttagcgtcttttgctaaaaccaatgcacctccatcctctgcaacaaaccaaccgttgtagtcttcttcgtctactttaattgacagtgtaaagccaccttctactgcattgacagtccagatgtctttagtagcatcagtaatttctgcagaactcccttgcttcaattcgtaaactgcaggaacctcagctgtgtattctgcgattaaagcataagtactctccgcatcaattgcgttgtttgctgatccagtagttaatgcaatcacctgaccgacagcatcggctacaagagcaataccttttgcggcatcaccctcagatcctgtaaaataaaccaaagctgttccgttttcaaatgaaggagcagcaccttccccaacggtcaaggttgcatttgatccagcgtccttcaccaactttccctcagctatcttcaatgctactgcatcagcagcatccaatgataatgtagcatcgccttttagataggctactacatcattaccttcaccattcaggagagccaggttatatttaaaatcaccttcttcaccctgaattgcaaccaatttccattttgtagcagtagcccaatctgtagcggtgacagctgtctgtgttgctgccgctgcaggagtacctgtctcatctttaagaccggcagtcaaagcaacagcttcatctgtcagcgccgtaccaatggcaaaagaagattccgccgcaggagttagccccttagtcagcgtcaccacctttgcatctaccgtcgaaaatacaccggctgccagtaagacagccaccaacgtagaaaactttttgttcataattcctaatttaatattaataatagtgtttttgaaaaactcgctcatcaacggattcatcaaggctgattatagctaatgactagctaaaacgttccttttttctagtcattctttcccctatgatttgacttcgtgtaggaaatgtcgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgactagctaaaacgttccttttttctagtcattctttcccctatgatttgacttcgtgtaggaaatgtcgaattttatcctaactttgctgtcctattgataataaagcatataggttgagtaaaaaatataggggaaagtattgcctattcaaaagttatgcctacttttgctgacgagaaaaaaggaacgtttattttagtcactacgcagagttcgtaataacctataaaactacaccttacacttcatttttagccaccacaaccagcagtaaaagaagcttttggccatttataactcactaataatcagcatacttgatttagactcttcaaaagagattgttaaaaaaggaaaatcgagcctattttaagaacaaaaaagggccatcgcttgaaacgacagccctaatacattataatatagataaggatcttacagattattgatttcttcttcgtgtccttgaacatgcccttcgacattagcataatccacaatattcttgcagtcacgatatatcttaaagccccggaagacgaatcccccggggcttgtttttgtctgttgtagctcttcacagagatcaaacagaagaactttatttcattactttagtattaatacataccacttattcacctatcacaggttacttggctattaactcaacaatcaaacacgccacgtggtatttatttattgattataaataatttctattattttacgattgcctttacagcagcttcaccttcaacagctacaacaatgatacctgcaggagcagagatcgttgcgttgtcggaagaaataactgtgttcgcaattgtctgtcccaagatattgctgatagcaactttcttgccttcagcacccttgatgattattgcaccggttgtagccacaactgatacttcagaagtgttgataccttcgttagccaccggagaagacatgctttctacagcaaatttcattgcactggcatagttgtcagtcaaagtaacgaagccattgtccatcttcaggtatttcttgttctctacgcaacgtactacgtagtagtcatcagattcatcgtttctgaagatattgaacttgaagttgttcaagccacctaatgtaccttcaccgtcaagttctttagctacattcacacgaacatcgtttactacggtattcaatgtatcagggctaaccaatgttgctgctttgaacattactttgtaagtatcttctccttcgatttcatagatattaccaggattggagtatgttgcagaatctactgagtaatacataaacaatctgtctgttgagcctttcaggttgtgagatacaaagaatgaaggcagggtagcctttgaatcggctgtatccaaaaggaatgtcaaatcttcgtcagcaacagtcttgatagccaggtttgcttcgttgctatcagtcatagaaaggtaaccacctgttttagctttcaacgctacattctgctgttttgcttccagagagaaaccgatagctttagtcaacaggtaagatttaacatctactgatcctgcagttgtatatggtgtaccatctgcatcgatcttttctccttcttcattcacagataaagaggtagcccaagctgttcctactgcattgatatacgggttggaactttcgtcaaaatcctttgaaggatctgtcaaaacactagccggcataatagaaaccgaaccgttcagatttttcttaagaacaaactgaggagcatctttcgatttattgatttttacaaaatttgcagccggatcgtttgacaaatagtaggatgaaccgatagttaaatccatcaatttaatagcataagtacaataaactactgaatcaccttttgatttcacttcatgtttaaacgcatcacgcttgtaagcataattgtttgtgatatcattgatttctccacatttaataaactcgaacaaagctgcttcagaaacagacgacgtaggtacagtcaaggaacattctgaagctttaaacttagttgctgcgtacatttttgatgaacttgcagaattatcctttgcaaatgcaatagttccgtatacgcttgtttcttcattatttacaaaaccatcatacttagttacactaaccggaaccagttcaattgttttacgaactaaagaaaggtctttagaggaaacagaagtaccctcttcgtcattatatgaaaatacaatctttccattctttacatttccggcatcaaatgtcaatgctgtacccagggtagctgttacatcggctcccagcgcgtaagcgcgagcagaagctacataatattcaccctctttctctgtgttgtacagttttgcaacaaagaagttacctgtttcacggttagtgaaagtgatagtcttattttcttcattgacatcagaaactacaaactgcgactgtggggcagttgcatcgattaaagaagcaggatatgccagatactggaattctttttcagtagtggtgctagttcttcccactgtcagatatttacctctttcttctgaagttattccactcaggaaacggatattgtaaacagttttacccgtgttattaatcaaagtcaacggatcaacaacattggcatcggtgaatgcaaagatgtattgaggatcaccgacaacagtagtcaatgtacccagactatgaatagtgtaagtaccgacctgtactgccttctgaccatgatcaggtttgccggcttctttctggaaacggaaattttcaacagtgattgcatacttatcttcgttattcatacttgttgtcactttgaaaacagcattcaggatagaaacctgtgttccattcgtcatatcttctttcaaagtcgttcctgtgtagaagttgaagtctttacccatcattgttgtgatagcaaagttcttaccatctttctgttcatctttatgtgtctctgccaataggttttcgctggagcttaaagtgatgaatgtacaagctctgaataaagattcttctgccgatgtaattacagttacatcatccaactctttcggccatgatgttgccagataagtacctgcagggattacgcgaccttcacccggattaatcagagcgtcaaactctgcttccacctcaaaagctttgatatggttcttttcgaagatgttgttatcagtagcaattttatcggctttgaaagagaagaaaccagtcacttcatcattcaaatcttcagctgtcataacaacagtcggaactgcgaagaattgaagttccgcacctgttgcatcaacagtaaaagctccacttgctaatttcaaagcattcgtgttcgctgttgcacccccatgataaggggtaaacttgatacctgtagctgctacaatctctcttttatcaccagatttagctggagaagagaataagctaacgtagctcttaacagcatcctcatcatcatcaacagcaatcgctttcaatgatgttgctgaaatattattaacatcaggattaaacactacttcctgtttagttcctttgttaaccagcttaaaataagcagagccatcagggccattagctactgtaacaacctgaaacagatacaaatcattgtgcaaataatcatccaaaacagcgccagcggcatctttgccttccaaagaggtgaatgtagcattttcatatttactacctgcagtagtatttgtaacttccaatgctttcagatactctgaaccttcttcccctgcagccgcaggtaaaccaatgtaataatacttgcctaaatcggcacttttagctaaatcaacagtcaccgacttcggggtcgggtctgctgcattagcactactaaacaacgcacctaccatcagtagacctgctgtcatcagtgtagaaaactttttgttcataatttacaatttaatattaataatagtgttacttaaaaagccttttatcctcaagaaatagaacgcctcccaaagagaatgactagctaaaacgttccttttttctagtcattctttcccctatgatttgacttcgtgtaggaaatgtcgaattttatcctaactttgctgtcctattgataataaagcatataggttgagtaaaaaatataggggaaagtattgcctattcaaaagttatgtctacttttgctgacgagaaaaaaggaacgtttattttagtcactacgcagagttcgtaacagcctatagaactacaccttatactttatttttagccactacaaccagcagtaaaagaagcttttggccatttataactcactaataatcagcatacttgatttaggctcttcaaaagatattgttaaaaaaggaaaatcgagcctattttaagaacaaaaaagggccatcgcttgaaacgacagccctaatacattataatatagataaggatcttacagattattgatttcttcttcggaaagcccggtacactcagcaatcaacttaatgggagtacctttttctttaaagctcttggcaatagatattttttcttcttcgcgtccttcaactttagcataatctacaatattcttgcagtcacgatacaccttaagcgcctcatcgtattccaggcgctcctctttggtcagattggctataccggccatcttttccagcttctcgaatagttgtttttgtgccttgaaaggcatacgctccagtttgtccatattctttaaggtaacttccagttgatcaatcgtctcctaacaaagaaataaaagtgtctatatcgattaagtcaactttgggaaaatcgatatttttcaaaatatcaaaatggtgatcctgactaacgatataagatgcattagctgcaatagcacaatcaacaaatttattatcatcaacatcctgttgaattaaattgaaacgaaagtgagcatcaagctttattgtattcttacgagttataatcgccttaataacattttgagcaatgacagctcccatctttaaagtaagtatttcctcatattcagtaagtatttcattggtataacacaatgtatacttttcagcaaagaaatctttccatactttataatagtcacccctcttagacaatgaaatcaacaggcagtttgtatctaaaacaactctattcatcattttgtcttataagatgtacgcatatgttcatgcttccagccttctacgaccgtattgttgatctgcccactatcccataacttatcaatttctttttctgctttttgggcaaaataatttgacaacatatcttttatttcattaagtgtatcttcactctcaacatatgccatcaaatccaatatttgtagctgtgcaggattaaaaacagttctttccataatgcctccttttattacttattacaaatataactatttttcctacgaaaatgatgcaagaaatgaaaacaatgattactcttttgaattcttactatatttgtaggataaagggatttgttggaaacacgattgaagtataaatacaagagtaaacgataatgattgaagaacgtacccgggaaacgatagaatgtcccgcaggctaaatttgcagtgatggattgccggaatatcagcacgatcagccataagtttgatgccgtgatgtgtgctttcggtctaccttacttatcaaaggaagaaagcaggaagctgatatcggatgcacacctgcttttgaatcccggaggtgtcttgtacataagtacgatggaaggcgattatgccaggtccggttttgaaacaaccagctttagcggacaaaacagagtctttatctattaccatcaggagaaattccttaccgactgtttacgggataccggatttgaaatcgtagatttgcagcgtaaggactaccccgaaccggatggaacattccttactgacattatcttgattgcaaaacttccggctacctgtccatccattccttaaactcagcaacacgttcacggctgacgagtatatcctccttttctttccggttgccgagtacaatctttaaccggttggacgaataagcaacaatgtcctggattgcatagaagtttacaatgaaattccggttaacccggaaaaagagcacaggatctaccagttgttcgatcttatcgagcgaatggtcgatggcatactcttttccggtatcggtccggataaaggtgttcctttccataataaaaaaacagctaacggataacgtttgcaccgacctgtaatgctcgccgactttgatcagaaaccgttcctttctttgggaatgcaactggcttattatagactcgatcctgaaataatcgatctgccgccgatgaaaagtattgaatttttccaatgcggcactcaaagcgtccggggctatcggcttcagaagataatcgacactgttcactttaaatgccttcagggcatattcatcgtaagcagttgtgaaaataaccggagtttgtattttacatgtttcaaagatttcgaaactgatcccgtcttccagttgtatgtccataaaaataagttcgggtgccggatttccagccaaccagttgatagcgtgctcgatcgacccgagcacgccaataacctctatttgtttgtccgcctcttccaataaacggatcagtttatgggccgccggacgttcgtcttctatgatcagtactttcattttatatgctgttgattggtagttttactgtaaaccggttgttatcagtttctactgtcatttcttttcccataatcagctttaccctttctttcagattggttaaccctgtcccgggagtacttttcaacgtattccttttttgtatgttattggtaatgacgataaatgaatcttcttcattatggataacaatccttaggggattctcttcagaagccgcattatgcttgagggcattctcgaccaatatctgcaaagagatagggactatactgtacttttcagcatcccggatattcatttccaattgaatcttgtccccgtcgcgttccttttggagatcgaaataccgactgacaaatcttatttcgtcttccagcggaatcaggtccgtttcctcatgatccaggatatacctgtagatgccggctaactgctgaatatagcaatccgcctttttagtatccacgtagatgatttcagagagcgtgttcagactgttgaacaggaaatgagggttgacctgtgtcttaagtgtccggtatttatatttcaggttttcttccctcagttgctgttcacggtccaccgcttgccgccagatactgtaaaagaagaaagcggaagccatcaaagcacagacagagtaatatttgatagtctgcggaaactccacctcaaacaagttctttataaagtgggtggtatccaatcccataatcagataaaatacatagatctgtaaactgataacaataagagaaatcagcaagatgacaagcatgaaaacaaggaataccggtacaatgatcttctttactttcctgatcggcatagacaagtaataaccgaaaaaccagttgctgatacccagcgagacccaaactagaatagacatagtagcacagaggagtaccgtcgacagttggaatggatttccggctgtccaccatttaaaaatcagggcaaacaagatgttaaataccagtaccccaataagtaatttcagttttttgttctttttcatgttcttacaaatttaatcttttttattcacttttcaacgagtgtaaagtaaaggggaagagaccggtttatataattatagttgcagagtggtggttttgtgttgccgaaccgttttgcccggtgtttgaaccggaaaaagacagactcgatttcgattaaatcatttcttatattccaaaataaataaacgatattccaaatttcatttatgaggacaaaagccaccttgtctttgtgtaattagttttaaatctgtaccttgcgcgcctttaaaacatttattaatgagtaaaaagcgttatgaaaaagaatttatcttactatttactgttacttttttgtgtctccggactatttgtttcttgtggagacgacgatgatgaaaaacccactatcggctattccggaaaagacataagcggagatgccgggattgcccgcgataaagaaacgaaaaaagccgttttgagcgtgacttccgataaagcatgggaattatatgcaggttctactgcagaagatatcgatatgaatactccttgcctgaccggcgatggaaaaggctcgttcgatttgagtgtcgatgcaggaaaaagacaaatattcttatttaagaattcagaaggtcaggctttgttggctgaaactcttttgcctgttcatggatataacttcagagatctgggtggcataaagaccagtgatggtaaatttgtacgctggggaagattgttccgtaccgacgaaatgaacaaactagatgatgccgatcttgcttatctaggaagtacaggattgaaaacagtagtcgacttccgtactgagacggagaaggaagggggattcggcggtattatgcgtccatccccagacattttgccttcgacagtaaaagaagcaagcaatctgccaatcaatgcaggcaatatcttttccgatgaaattcttgcaaagataagcggaggtactactcttgacgccatggcacaagtaatggttaactcctatatcgagatggtgacagtagatgaatatgtagctcaatacaaggaattcttcaagcttgttcaaaacgaaaattccttgccgctaagttaccattgttctgcaggaaaagaccgtacaggagtggctactatgcttatcctaactgccctcggtgtcgataaggctaccattatggaagactatctgcttagtgcaaagcttgttgaagcaaaatataaagattatgtagatatgatcaaagtgatcgccccactagtcaccgtcgatgaaaaatacctgaatgccgcctacgataaaatagacgagaagtacggttccatgaccaagttccttactgaaactctgggtgtggatctcaataaaatgaaacagttatacttatattgatcatttataaataccgattattccatctgcggtgatcgtctcggcactaatactgaactttctgcaactaccgttattgtagaacctgatactggctttaccttctttatcagggataaccgaaggattccagtagagcgtacggcggtaatccggttccggtgggaggatggaataatccggactataaaattctttaacctggctgtaaccttccagccaggtttttcgtacccctttacctgcatccgtcgggatcttatcttccggaaatgtctcaatgaaaacaacgcaactataaaacttgtctacttccaacggagacatcctagggtctgcatatcggcacataatagaaagatcctcattgatatagatggatttgatggcttctagccgtatcagtttatatttgttgtaatccatttcagtagccatagtcggttcgtagttcacaacaaaaaggggcattcttcctttatattgcaggtattcatcctgccgggagaaggttttcctgaaattgttattcatgtttatcatcaactcatgtatatcttttccgatatactttccctggtctgtaatatcgtcccattccgactgtacatcataataagcgattgatttggaacggttgttgaatatatccttttcccgtgatctctttttagcagttacggtcacttcatccaggcgaaggactctctctttattacctgctttactcaaggaatcctcgtaagctgtcaggaaagcatcgatatcttcttccggctcctgagtgtcaggaacttcttccgaaccggattccgctgtttgctcttcttctctatcggcaagggttatctgcatatctgcataacggaatcttttaggttcaggtgtaaaaagtcggtccagtatgatccgatagtcttttttctttcccttctcacttaccgacaagatcatattccatttcccggttatatcggcccgaaaagcgaaatggcccagactgtccgttacaaatacatcgaatgcactggtagccttttcttcttcacctcttttaagcaggaaagaagaaacagtcacgtcgcgtttaggaattttccggacaaaggaaaccacctggccgtgcatctcgataccttgctccggcctgtacttcaaatccaacggttctactccggccatctgcttccaagaataacgtcgccaaccttgcaccatcataagcaggtcgagagatgaacgatggatggaatcatccgcttcaaaataataagacggattgtggacgtatccttttatgtcggacataagcagtaagtctgtcaggatattgcagtccgacttaacttcattcataccatccctcaccgataaagaaaagggagattgtaccgggttctcttcctgatcggtcactgccaactccatgtcgaccggttcatacggatcgtatgtttcttttacggtttttgctttaattgccagtggattttctttattattgaatatcagacgatcacaaagtatttctccattactgttgaaaactactatttgtgatacaccggaaggtaatatcgttttatctaccttgaaacggagttgttcactgtgaagtacattggcaagacaatagttatacagcttgcctctgcaaatgatgaccattcccaacatatcggcgggtgtctgttcattcttttgtaaagagatttcgagactatcaggggaagaaaggttgtctacctgtaagcaaaatccttgtggtagagattgaggcatatcgaattggtactttttaccgttatagtcaactatggctttttgtttacccccatgtggagtgtaattaaagaaacctttcccctcgtgtgttacattaaagccgacgatttcttctttgtcttcatttataatctttccggttgcatccagcggattaccgaaagcatctgttatttcaaatgcgatacgggaagggacatcctggatcaggtttcctccctccggatagaacttcaggtttacctttttccctttttgaggcttttcccgcttcttcggatatttaccgtagccgtatttcagcatatctttttcctcatagtgcccttctgttttcggcttattgaataccggtaacaggcgggagaagatagcatcttcgccaaagttcaacatatattttgtgtaggcacggacttcatagaaaccggaataaaaaggaagttgccctaatgtgaaatcaccgtggcactgtccattctcgactttcagtacccgtttatctatgatttcaccaccgggattcaatagttctacatatagtgttttgcttaacccggtcgcttcgtgcagttcggaagttaccacataacagttaaaccagatattatcgccctggtaataactggtattgtcaaaatgaagatatactttttcctgtggtatatattgcgaaaactgatccgtagcacgaatataacgggtgagtttgttgatcacactgtctacttcctgccctgaagcctgcaggcaaaacagtaaaagggaaatataaccgataacttttcggaatgttttcatgagaacttcgtatcttccttgcatgtaataatttacgaagttacagataaataaaatgctgcaaaagaaaaacatttaaattttaattgcctatatcggttaatatgtcttttaagttggcgatgaccttggattcgttttttaaaagatcataattgttatgtccaccggcataaagaatacattttatccctaatgtttttgctacttctgcatcatgtaccgtatctccgattataattgctttgccaggattcaaggagttgtcttttatcagtttctgcccgatcccgactttaccggttgcacagatatcttccgaaccatatatccctttgaacttgtccgttaaatggaaatggtcgagcatacgcaacagatccttttttccggcagcagataatatgtattggtctatgccttttgcgtttatcgaatccagaataaacgggacgtcggtatttaattccagactgctttcgtaacttttataatactccatatattcagctgaaatttcttcgatcgactctgcactaaaatcgatacctatccggatatggaattgtttgaccgggaagcagaatatatctttataagtatgtaaatccagttgaggcaagtctctttttaaaagcattttgttgataaccttgacattcgcatctacatcatccagtaacgtcccgttccaatcccatattaaagtctctgtctcagacatattcatctttttgagaagcaaagatatacagattcccgttataatcctgtacttccgatcatatagtgatgtattatttttctatatttgcgcccatctgttaattctgaatatatgaagtatttgtttgttgcctttcttgtattggttagtactgccatcccggcccagaataaagaaacctgtcgcgttgctttggtacaggcacatcttgcatggggaaacgtggaagcaaatctggatgcttttcagaaacgggtggagcaatgtaaagattgtgacgtgatcgtatttcccgaactgtttgtttccggttgtgaaatgaagaagaaggataaagaaattgcggtgcagaacaaagatgaggtggcaagttattatccggcagttatcgggaggatgcaaagctgggcggcaaatagcaacacattggtgatcggctctacgatttataaggaagcagggaaattttataatcgtttactggcagtgttcccggatgggcattatgagcattatgacaagcataattgtttcaggaaaggtagtttctctccgggggaagggcagttggtacttcattggaagggacatcgttttgccacttatatttgttatgatctccgcttcccggattggagccggaatgacgaccggtatgatacagctatctacatcgccaactggccggagtcgcgccgtgacgattggaaccgtcttcttcgtgaacgtgccgttgagaaccggacgaatatcattgccgtcaactgtgccggaaccgatcctgccggtatcatctatgcaggcgactcttgtttacttactcccgaaggagaaacggcagcagaatgtgaagcctacaaagatgatatacggattgtcggattgtgactgccgattagtattttatttccatactctctttcccattgtctaccgataccggatatagctgctgcgatcaaagttgttgatacaagagtatggatgaatcgtttcatactgattagttgttaatgtttttatcaatatgatactatgataaattgaataattgtatctctggaaaaaacataagtatttttcatccttttattcgagttactcgactatgtgaatacgcaaagtccgcgtattccgggaataaggcttttcgaacaaatctcaaacttttgcgactattgaaaaaaaatatatacatttgaatccctaacgaataatacagggagatagttgaaaaaaagagataataatatgtggtccattctggaagatttggcggtaagggattccgaaccagcctttaaatctctatatgttacttattatgaccgtattatgaggtatctcgtcatgtatgtaaaatcaccccaaatagcagaggagttggtttccgatgtattctttgccctttgggaaaacaggaaacagttgatggatatcaacaacttcgacgcctatatttaccggattgccaaattccgggtattgaactatctgcgggataataaatccctgacagttgatctggatgaagtgccgatcgatctttttgccttcacggaaacgactcccgaagacgattatatttcccgcgaactgatcgatgcggtaaataaagcgatagaacagcttcctacaaaatctaaactcgcctttaagttggttcgcgaagacggcatgaaatataaggatgcagcagaacatttaggcatatcggtcaagacgctggaagcccaactaacattcgcgatgaaaaaaatcacgaaaatattcaatctcgattaagggtgaaattcaattttcggtacttataatagaaagtatcaaaattgtatggatcaggaaatagaacaaatcatattacggaatctttcgggagaagcctcttgcgaagacatcatcactttttcagattggttggcttcatccgcccggaataaagagaacttcctgaaaatcaaaaaatattgggatgcggaggttaccggtgcaaagcttcaaaatccggaaattacttataataaactattagagaggatacgaaaatcggaacgaaaagacacagtccgtaaactctggctcaaatatgccggagcggcggctgtagctatcattatcggtattagcggctattggataggcggtcagaaaaatattacacccgtacaatactattcttacatcacaggaaattctatttcatcatttgagttgccggacgggaccgaaatatcattgaataaaaatagcatattgtcttattccagttcatacggagaaaagattcgtgaagtctctttagagggggagggatatttttctgtgacaaaggatagggcaaaagcttttattgtagatctgaacggctcaaagatttccgtattggggacagttttcaatgtaaagaactataaaaaagagaatgtaacgactgctacattgctggaaggctcgatccgttttgagacacctgatcaacagatacttttgaaaccggaccagcaactggtattcaataaatccgagaataaaatcgatatagaaaatgtatcttccgacctggttacggcctggaaaagtcatttgataaaatacaaatcaatccccttcaaagaatttctgaatatgctgaaagaacagtatgatgtggaaatcattctgtcgaatgaagtgctaggcaatcagaaagtaactggttcgtttgacgaaagtctgacagtagatcagatactcgacctaatgaaaaagaacctttctttcaaatggaagaaacaaggtgctaattatgtgattaattaagtgattattaacaaataaaaaaagaaaggagccatgaaaacgcaggagaaataagcatatactatttagaaaaacaaaaccggccattcttggaggaagcagccggttcagtttcgagaaattaaccgatcaattcaagctactggtaatagcaaggattgacaattagttaacttaattcatttacaaaaatatgaaaattatatggatcaacgaaatctcttttacaaaagaggttaaaagactattgcttcttatgaaaatcacattgataatactatttatatgtattttccaattgcaggctgttacttcttatagccaaacaactacaatttctattgaaactaaagaaattccgctggaagatatctttaacgagatagaggatcggagtgaatacttgtttaactaccgggatagtgatatcagtcattttaaaacaagaataaatgtaaagaacgggaatatagaggatattcttactcaggtactgagtaagacagacctgtcatttactgtaaatgacaggcatgtcttactcaggtactgagtaagacagacctgtcatttactgtaaatgacaggcatgttactatttttaagacacctaaaacagaaagtgataaccggaaagtaataaccggaaatgtaaaggatgacagaggagaacttttattaggagtttcaattcttataaaaggtacttctcagggaacggtaacggatatagatggcaattattcaatagaagtacctgatgatcaatctgttttggttttcacttatctgggttataaaaccaaagaattatctgtttccggaaaagcaaaactgaacgttgttttgatggaagatactcagaatttagaagaggtggtaattgttggatatggaacgatgaagaaagagaatctgactggtgctgtagctcaattgaaaggggatgctttggaaagccgccctgtaacgaatatttcgcaggctttgcagggaacggttgccaatctgaatatttcatcatcaggaggtggtgctcccggatcaaaaccgtctataaatattcgtgggtatacgggctttggcttgaacagtgatggtaatatggagtcaaaatcacaatcacctttaattataatagatggaatacaaggtggtgatcttaattctattaatatggaagacgtggaaagtatttccgtattaaaagatgccgcatctacagctatttatggttcgagtgctccttatggcgttattatcattaatacgaaaaaagggaaaagaggttccaaggcaactataacatataacaataactttggatttgcacagcctataaacttaccacacatgcttaactcacttgattttgccaatctttataatgaggcggcggataatgcaggtatagcacgaccttttactgatgaaaacattcagcgccttaaggactatcaagctggcatattgaaggatgaaaccatcgccaatccggctgcaggtacagatgactggctgacatggaccggaaatggaaataatgactggtttgatgtattttttaagaatgtatcttttagtcaacagcataatataggagtttccggtggtaccgataaaagcaattattatgtaggtcttgggtataatcaaaaaaatggtatgtataattacggggatgatgcctataagcgttataatatgaggactaatctttccataaatctaacgaactggcttacttttaatacgcgtggatcttattcacgtgccacaacagattctccgaatacttatgaaggaaaaaccggcggctatatgcatcagattgcaagaaaatggcccaccgccccgttgcgcaatcctgatggttattactcgtatgcaagtgacattcgattgcaggatgaaggaggacgttcgaaagcaacgacagatcaagccatattgactggtgagtttgttattactcctttagcaggctgggatattaccgccaattacactttcgatggtgcttatatacacaaatccgatcatgaaaaaacattgtatgtaactaacccgagtggagctacaaccttgtattctggaacttctcccaatagtttctcaagaactagcaacaagaaccagcatcatgtaatcaacatgttctcttcttatgagaaacagattaaggatcactattttaaagctatgataggatatacgcaggaactttacgataatttggaacaatactccggcaattcttatttgtattcggatgatgtaccttctttatcattaacttatggtactgctccctctatcagcgataaagcaagtcagttagctatccgtggaggattcggacgaatcaactataattataaagaaagatatttggtggaattaaacggacgttatgatggaacttctcgttttctgaaagatgtacgctacaaattctatccgggagtttctgctgcctgggttttatcgaaagaaaatttctggaggccaatagaatcttatgtgaatacattcaagttcagagtgtcttatggctcattgggtgatcagggatttgtagatagttattatccattctatccgtccatgacaacaaaggctcccacaggtagcaactggctctttgcagatggaagacatgcttatgtgagctatccgggactaattaatccgaacctgacctgggttactactactacaatcgactttggagtggacatggcatttcttagcaatagattaaattttacatttgactggtataaacgttcggcaaaagactttgtcggtccggcagaagtattgccctctattatcggtgcaagttctccacagacaaataattcagccatggaaacgaaaggttttgatttatctcttagctggaaagatcgtataggtgaatttaattacggtgtaaattttgtattaagtgactatatgagtaaggttacagattacccaaacccaacaggattaaatactacctggtacaaaggacgtaaagtaggggatgtctggggatatgaaacagtaggattctttcagtcggaagaagagatagcgtctgctcctacacaggaaaaaatctatgcaacatggacgccgggagatatccgttataaagatcagaacggagataatagaattgactggggagataacaccctggaaaatccgggcgataaaaaaatactcggtaatacgactcctcgcttctcatatggtctgactttaaacggagattacaaaggattcgatttctctgtctttatgcagggagtagcaaaacgtgatgcctggcttagttcaaatatattctgggggataacaggaggtcagtggcatagttctgttttgactactcacacggatagatggtcggaaaacaatccgaatggatatttccctaaatattatttgtcttcgcaaaatgataagaatactcagactcaatcccgttataagcaaaatgcagcttacatgcgtatcaagaatttgcagttaggttattctttcccgaaatcgttgatcagcaagattaattttgaacgattaagagtatatgcaagtgtggataatctggcaacttttactagtctgattgaaactgttgatcctgaattttcagcgagtgacggaaaattgtatccgttacagcgtacctggtctttgggtatgaatattacattttaattgtttaactatatgaaaatacaagtatgaataagtttaaattcaaattatatacgatagtcttttccttgattttactttttccggcatgtaatgatgattttctggaaagaggtccgatcgtaaatataagtgatgccaatttttggaaaacgacaagcgatcttgagctatataccaataatttttacaacagtagtttgctggatcgttatgctgattggggatcaataggcccgtatggtgtagatgccgacaatggagcagacacgcaggtgacatataattataatacccgcatgaatggggaatcgacagttccagcttccggtggcggatgggctatcggtgattggtctactttgcgtaatataaattactttatgacaaattatgacaaagtggatgctccctgggatcaggtaaaagattatgtaggggaagcattattcttccggtcactcttctattttggaaaactgaagagctttggagatttgccttgggtaacctctacactcgacaatacttcaagtgtgttgtatgaaggacgtttaccccgcaatcaagtggtcgattctattatggttgatctcgataaagcaatagaatatttaccggaaagaggcccttcgtatacaggtagaatcacaaaagaggttgctttattgctacaggccagaattgctttatatgaaggcacatgggaaaaatatcatggaattaaaaatactccgtttaaagtagaaaattctgatgggacgaaatttattcaaaaagcggcagaagcttcgaatacattgattgctatggctgaatcgaatggaaatacaggattagcagactgtacgggagaagccggatatacgaacttgttcaatcagcgtgattatagctccaataaggaagtattgttgtggcgtaaatattctgttaccgacgggcaatatactcgctggggagcttattattatggtgcaggaagaggtatcactaaaaatctggttgattcttatttgtgcaaagacggaaaacctatttctacatcggatatgtatcaaggggacaaaacattgaaagatgttgtagctaatcgtgatccgcgtttgaatcagacaatatttgttgacgacgaaaagcataccctttttgcggacaataatacattctttgctacccctgctttcgaaggcgttattaataatagttgtcctaccggatatcaattgtacaaaggatataatacaaattggatagaatgtattaatcaacaaagtactattggaactatctacttccgttatgcagaagctttacttatcaatgcagaggcaaaagcagaattaggaacaattactcaattggatgtagacaaaacgattaatgccttgcgtactcgagttggtatgaatgaaggtttattgaatatcaataacattacgaccgatccaaactgggaatttaaaaatatcagtcctctcctgaatgaaatacgcagagagcgtaagattgaatttgcctgcgaaggtttccgtaaagatgacattttcagatgggcagcagcagatgaattgatcgttggcaaaaacccaaaaggagcagtaaaagctcagtgggcagattatcctaatacaacagatgcttttgtggaagcttggaaggttttgggagaagacgaaaaaggctatatcgatccttttaaatcatatccagcaatggctaccggatataaatttaatttgggtagagattatttgtcgcctataccaacgaatgaattaacattgaatccagagttaagacaaaatccaggatggtaagattcgtttaacttttataagaattctattggtagttaagctaccaatagaattctcattcgtttatactaattgggtttgttattaaaacatttatatgtatgaaatatattttttactgttttatcttattctttactgttctacctgttactgcacaatggaaatggtacaatccgcttaaaaatagtttccccgttatccaaaatcaaggatttacacaagaagtaggatactcgtaccaccggttgcccgatcgggcgaaggatgttgtgcgaaaagaagtctggaatctttccagggaatcggccgggttgtcaatacatttcttctgtaatgcaccacagattaaagtccgatatcaagtaacaggcggttttgccatgcctcacatgccatcaacgggggtttccggaattgatctttatcgcatggataacgatctttcgtggaatttctgtttcgggaattatgcttttgccgatacgatagtatattcatataatcatatgaaaaagaatctcggtcggaagaaaggtttcgaatacaaactgtttcttcctctctacaacggtgtgaagtggatggaaatcggcgtagcggaagatgaaaacattgagtttgttcctgtatctaaagaacctgccattattgtgtatggtacttctatcgtacagggagcttgtgcttcacggccgggtatggcctggactaatattttacagcgctcgttgaattgtccggttataaatcttggtttttccggtaatggtaaactcgaagaaaatgtattagggtttatcagtgaactgaatgctagtttgtttattttggattgtatgcctaatttcccgaatgacgactatgaaacgatttatacgcatgtagttaatgcggttaaacaacttcgtttgacacataaaactccgatcttgctcgttgaacatgccggttatagtaatgccaaaacagattcgacgcaattcgaatattatgatcacacgaacagagcttccagaaaagcattcgaaacattgacagctgaaggtgttccgtctgttttttatgtttcacatgaagaactggattttgatccggatgcatgggttgattatgttcatccttcagacataggtatgcaacgacaggcaaaagttttagagaaagcaatacgagatattttacaaaaaaatagcaattttctgctttagggacagatgatatctcatagggttgttaatatcccaaacacctgttatcagtacagatatatatggtacgaactcttatttttatgcatcgttaaataatataatatatgaaacgccgtaattttcttgaatgctgcatgctttccctggtagcggcagcagcaaaagccaaaggagtcagtattgagatggagacatcaaaattcaaccgactgaagtttggcgtcatctcggatatccatccggatataatgcatgatggcgaacaccggctacaggtctttttggaggctgcagctaaaaataaagttgattttattattgagttaggtgatttctgttttgccaaagaggcgaacgtccctttccgaaatttatgggacaagtaccctggcgataaatatcatgttttaggtaatcatgatatggatatctgcaccaaggaagaatatatgaaatttgtcggaatgaagagccgttactattctttcgataaaggtgattttcattttatcgtgcttgatccgaacaacttatttgttgatggggaatatattccctataaaaacggaaatttctatgtagatatgtcccaacgcgaacatctagatccggaacagattgaatggttgaaaaaagatctggctgctactaataaacgttgtattcttttctcgcatgaatgctttgaaaatacggttcagaacagagaactagtacgcagtatcctggaggcagaaaataagcgatgtggctttaagaaggtaattgccgctttcagcgggcacgatcatacaaattatacaaaagagatcaacggcattacttatattcagatcaacagtgcctccaaccaatgggtcggtgaggaatatgcctgtccggaacgcttcagtgaggagataaacaaacggcatccttcgttaaagtatactgttccttataccgattctctttttgcaattgtaacgttaactccaaactgcttgaagatgaaaggacgcgagagcacattcattgctcctacccccatagagatgggaataccggatactctatatccttttccgttagttccctggatcaaagatttttctttacacattaaataactaaaaagaaaaaggtgtgtcggagcgaacttggtcagccatgacataccttcttcttttgtattttgaaaacttgacttttactttcccaactccttattataaaccgcctcatcattaataatgcgaagagcctctttaaagctttcgttatcatcgtttataatctggaaatactcggccatatcatacaaatcgcgggcgatcaaggcctttatctgaagggtgataagaggtttggaacgattgtattgttcttcgttgaactcgatcttttcatctttacccaattcgatcagttcctgtaatgtttcttccggaacggtaaaatcttttttgtactgactgaatttcggatattttttgttcatcgcggcacggttacggtccagataactcatggaaacacggtttaccagtccggtagcaaccaggctacgatgataatccgtataacgggtcgtgtcgaccggaataaagacgtcgggcatgataccgccaccaccgtaaacgatacgtttcgtctccagtgtattatatttcattgaatccgggaaatggatgctgtcggcactcatcagctcgccacggttgtagcggtcgatcaggtcgtgctggtagtcttccagtttgccgttctcataatgtttttggatacttcgtccggtaggcgtgtaataacgggcaaccgtcaaacgaatcatcgagccgtccggcatagggatcggtttttgtaccagtcctttaccgaatgtacggcggccgacaacaacaccacggtcccaatcctgtacggcaccggagaggatttcactggcagaagcagacgattcgtccactaataccaccagacgaccttcttcaaaattgcctttggctgtagattttgcttcgtcgcgcggctgtttgtttccttccgtataaacaatcagtttgtctttatccaggaattcatccgccagttcgatggcgatgttgagataacctccgccatttccctgcaggtcgaggatcaggttcttcattccctgtttttgcagtttagcaagcgcctcacggaactcgtcagccgaagaagcggcaaaacggttcagtttgatatatccggtctgcttgtctgccatataagcggcatccaggctggttacaggtatcttgccacgaataatcttgaactcgattaactccggattcttattacgcaatacttttatgctgacttcggttcctttcggaccacgcaagcgtttcataatgtcggtagtcttcattttaacaccggctatcagggtatcgtcaaccataatgatacggtcgccggccactagccctaccttttcagaaggtccgccagggattacctggataacatataatgtatcggtcaacatgttgaactggatgccgataccgtcgaagttaccttgtagaggttcggtcatttcttttgtctcttccggatccatgtagtttgaatgtgggtccagtttttccagcataccgataatcgcatcttccaccaacttggaatcatccaccggatctacatagagattcgagatggcatacaatgccatggataatttgcgggcatcctgattcggtttctgggccactgccgacgtgatagcaatcatcgcgacaagcagggagaataggattcgtttcattttaaatcttttatttcgtaaattgtcaatataagttcgtaccctttggcacgaactgagaaatatcttttccataacgcagcagttcgcgtacgatactggagctgatatgtgtatgttcgggttcggtaaacaggataaatgtttcgataccactcagtttacggtttacgtcggcaatacttttctcgtactcgaaatcgtttaccgtacggataccgcgtaagataaaaccggcccccacttcctctgcaaaatcaacagtcagtgagtcgtacgacattacctttactctcaattcctccttatacaggttttcgatcgcttccaaccgttctttgagagggaaataggtttgtttcttctcgttgacaccaatagagataataatttcatccaccagagccagtccgcgacttaccaacgattgatgtccgatggtgaagggatcgaaagttccggggaacaaagcaatacgcttgttcagttgacaggcgactggtgacaggtgaccatttttgtcgccgtcaatttctactgcactgctctgattgttgcgtgtaatatctttattttccatattgtttcttttcaaactgccaactgccactcgtcaactgtcaactaacaacatcttcttcaataaccaggttatcaatgataaagttctgtctttccatggtgttcttccccatatagaattcgagcatatcttttaccaggtcttcttttttcattgtgaccggatccaggcgtatatctttaccgataaaatgtttaaactcgtccggtgaaatctctcctaaccctttaaagcgggtaatttccggattcttccctacagcctgtatagccgccaaacgctcttcttcgctgtagcagtaatacgttttctgcttattgcggacacggaaaagcggggtttgcaggatatagacgtgattacgtttgatcaggtcggggaagaactgcaaaaagaaggtgatcaacaacaagcggatatgcataccatcgacatcggcatcggtcgcgatgatcactttgttgtatctcaatccgtccaatccgtcctcaatattgagggctgcctgcaagaggttgaactcctcattttcatacacgatcttcttggtcaggccataactgttaagcggtttaccacgcagactgaaaacagcctggtagttcggatcgcggctcttggtgatagatccgctggccgagtcgccctcggtaatgaagatgcagctttcttccgtacggtcgcctttgagatcgttcaaatggatacggcaatcgcgtaatttcttattgtgcaggttagccttcttagctcgttcgcgagccagtttggtaacaccggctatagctttacgttctttttccgactccagtattttgcggagcaaagcctccgaagtgtctacatttttatgtagataattatccagttccttcttgatgaaatcacccacgaatttggcgactgtcggtccatcgggacctatatccttcgaccctagctttgtctttgtctggctttcaaacacaggctcttctactttgatactgatagcggcaacaataccggcacggatatcggagtattcgaagttcttgttataatattctttgatcacacgccccagtgtctcacgaaaagcagaaagatgtgttcccccctgcgtcgtgtactgcccgttcacaaaggaataatattcttcaccatactgattgctgtgagtgataaccacttctatatcttcaccgttcagatgaatgatcggatatagcggctcagtagtcatattctcgttcagcaggtctaccagaccattacgggagtggaatttcttaccgttgaagaggatggtcaatccggagttgaggaagacataattcttcagcagactttcgatgaactcgtctttatactgatattccttaaatatttcgcggtcggggatgaaatagatcgaagttccgttcgcctcggcagtaggctgaatagccgactcttcggtaatgagcgccttgctgtattccacccgtttgcattctccgtcgcgaaaactggtaataaggaaatagctgctcagagcatttaccgctttgataccgacaccgttcaatccgacagatttcttaaatgccttgctgtcgtacttagcacctgtattcatcttactggaaacgtcgaccacttttcccagaggaacaccacggccatagtccctgacagagacggttccttcttctacggttacttctatggttctaccataccccatcatgtattcgtcgatggagttgtcgagtacttctttcagcaatacatagataccatcatccgcatagctgccatctcccaatttaccaatatacatacctgggcgccggcggatatgttccatccaatccaacgtcttgatatcgtcgtcattatacgctgtcggttgttgcattgttgaattcagttcttccatagaaaatccttattttaattttttaataaaagctcttcttgttttatgatgttcacgtttgaaataatcccattgggcctgtacggcattgttgcttgccaactccgggttactttcggcatattcgactcccaagccgatatatactggaataagatcattgaacagcagtgcatttactcccttgttctgatattccggcaatactccggtcaaatacaggtcgattactttcggttttgttttcaatgctttcagcagatgtatccatccgaaagggaacaaatgtccttttgccttctgcatagcatgcgagagactgggcagtgagattccaaaaccgactactttgtcatcttcttccctgataataagggttaccagatccaggcggatcatcgggatatacattttcacataatagtcgatctgcttctgcgtcagcggagcaaaaccatataacggggcataagcctcgttcagtgtttcaaatatcttctgtgcatacggccatatctctttcgttttcttaaacttcatggttttcagaccatatttctttttcacgatctctccgatgcgcaaatgcttctcgggaacaccttcgggtatatatatcttaaactcgtgccagtcctgatccttctcatagccaagacgctccatatgcttcgggtaataaggataattgtagatcgcagccattgtcccgagttggtcgaaaccttctatcaacattccctcatggtccatatcggtaaatcccatcggaccatgaacttcgttcataccttgttcaacggcccacttttcaacggcaccgaacaggctgtctactacttccgcatcatcgatgaaatcgagaaatccgaatcgggcacgttgttgcttccacacttcgttactgcgccggtttatcattccggcgatacgacctactattttattgtctttgtaagccagataatagacagcatcgcagacttcaaaagccggattcttttccttatctaacgtaaccatctcctcttcaatcaaccccggtatatggaagggattgtctttatataaatcgatattgaacttaacgaacttcttaagttcttttttgctggtaacttctttaattactacacccattggttattttaattagaacggcaaatttacataattaattcgttagatcgaccgtttacagttaagattaggacttttaacacctacgttttccgttcttgacatcctcgaaaacagagcggttcctgtacaaaagttactttattacgacaatttaatccgttttctaccaatattaataggctttgatcattcaggaattcataaaatacgttatatttgcatttaataacaggcagtgaaatagattatttaccatgaaaaacttaataggattacttatgttgacaataccttttattacaggcggatgttcatccgagctgaaaactatcgaagcaaacctggcatttaaagccgaagcaacaaccggcgaaggctctatctggcatccggatagaaatacattgttttgggtagacatcgaaggaaaaacattatatgagttttatccggataagcaagactgtaaaacatgggagttcgaccgtatggtgtctacggttgtgcctgaaacagatagtacggtgatcgtatcccttcaggacgagatcgtaagagtgaacctgaatgatagtagcctgacgtcggtcgctccgataccggatcaggaaggaagggttcgctgcaacgatgggaaatgcgatccggccggacgcctgtggataggaacgatgggattcggtgcacccgaaggtgccggaacactgtacaccgttgttcccgatggaactgtaacgaccaaactgaacaaagtaacgatctcgaacggcatcgtatggtctgccaacaaaaagtatatgtactacaacgatacggcaacaggaagggtggcccgttaccgatatgatgaaaagacggctgagatactctttgacggggttgctgttctcatggggcccggtacaggatctcccgatggcatgacgatcgatagcaacgataatctttgggttgctcaatggggcggttacggtgtctattgttacaatccctatacgggagaactgctggcaaaagtagaggtgccggctcctaatgtcgcttcctgtgcattcggcggtaaagacatgaatacgctctacattacaacggcacgcgccggactttcggacaaacaactggaagaatacccccttagcggtagtctttttgtttgtaatccgggagcaaatggtccggagccataccggttcaaataataacagaacagacaatataatttagcctgtttgtaaacagtatctcgattataattgtttattttgtagggagatgttatatctcttatttaatcacgaaagaaatatatgacgaaaaacaaatccgggaaaaaggacaacaaagaaaacaaaccgaaaaagaacaaggctaagcgcatgaaaaaagaagccatgctgcattctgtcatgtctgttttccagtcctctcccaaggaaccatttaattataaacagataagcaagctgatcggtgtggaaagccaggtccagaagctccaggtggtggaccttctgtatgatctttcagccgaaaactttattacggaaatagaccgtggccgctatcggtataacggcttgggaacaacagccgtcggtacattcggacgccggagcaacggaaaaaactcatttattccggaagatggcggagcacctgtttttgtggccgagcgaaactcaggacatgccatggacggcgacaaggtgaaggtacagttatttgctaaacgaaagggagctgaaccggaagccgaagtgatcgaggtactggaaagccagaaaaagacatttgtaggcaagttgcaggtaacgaaaggttttgccttcctgattaccgagaataagactttggccaatgatatattcattccgaaagagaaactgaaaggaggaaagaacggcgataaagcgattgtacgtatcgtggaatggccggaagatgccaagaacccgctcggagaagtagtcgatatattaggcgtagcgggtcagaacacagcagagatgcatgcgatcctggccgaattcggtctgccatatgtatatcccgaaaacgtagaaaaagcagccaataagataccggacactatcccggaagaagagattgccaaacgcgaggacttccgcgatgtcctgactttcaccatcgacccgaaagatgccaaagacttcgacgatgctctttctatccgcaggctggataatgcgaattgggaagtaggcgtacatatcgccgacgtaactcattacgtaaagccggaaagcctgatcgaccgcgaagcggaaagccgtgcgacatccgtctatctggtagaccgtacgatcccgatgctaccggagcgactctgtaatcagatttgctcattacgaccggacgaagaaaagttaagcttctccgccatattcgaactggatgaagatgccaatgtgaagaaatcgcgtatcggacgtacagtgatcaagagcaatcgccgttttacctacgaagaagcacaagaggtgatcgaaacaggtgaaggcgattataaagacgaaatactgaaactggatgcactggctaaaaagctgcgtgagaaacgtttcaaaaacggagctgtcaacttcgaccgctttgaagtaagatttgaaatagatgaaaccggaaagccgatcagtacttatatcaaggagtcgaaagatgccaataaactgattgaagagttcatgttgctggcaaaccgcacagtagcagagttcgtaggtaaagtgccaaaagggaaaacgaaaaaaacgttcgtttatcgtatccacgacctgccggacccggacaagttggaaaattttgcggcctttatccgccgcttcggctataagatgaagacggaaggtaatagcaaactggatatttcccgcaacctgaaccgtttgctcgacgaagtgcacgacaaaccggaagaaaacctgattgagacactggctatccgttcgatgcaaaaagcccgttatacgacagagaatatcggccattacggtctggcttttgaatattatacacacttcacctcgcctatccgccgttatccggatatgatggtacaccgtttgctggaacgttatctggcaggagggcgtagcgtggtaaaagcgaaatacgaagatatgtgcgaccactgctctacgatggaacaggtggcagcgaatgccgaacgtgcttctatcaaatacaagcaagtcgaatttatgcaggataagttgggaatggtattcgatggtgtgatctccggtgtaaccgaatggggattatatgtcgagctgaacgagaataagtgtgaaggccttgttcccatccgcgacctcggtgacgatttctacgacatggatgaagaaacatacagcctgatcggccgtcgcaagaaacgtcgtttccgcctgggtgatccggtgacagtgaagatcgcaaatgcaaatctggaacgtaagcagctagactttatgttgatggagtaaggttccaataaacatagaaaagggaatagagacagacaatctgacttctattctctttttattttgttttgtattcattcttttaccaatagatcaatccgagcaccccgcacccgatcagtgccaaccccagtaaagcataaaagatgcgtgcaccttttcttccgaatttgtttacaaaggttgcggctccactggtttcgaaataccagtcgaaattgaagatagcggcaatcagagagaatgctccaagagcgatgaaaatagccaacaggaagtaatcggtcggttccatctctatttactttatttctacggttcgcgatccgtccggattttcactgatcgttacatccaccacatcaccaggaagcagatcttcgattttttccggccattcgataaagcaaagagcaccgctatagaaataatcttccgtaccgatatcttctgcttcactcagcttattgatccggtaaaagtcgaaatgatagatcagttcgccggtttcgtcactacgatattcgttgatgatggcgaatgtggggctattgataacatcctccacacccagttcttcgcagatagcctttatgaaagtagtcttccccgctcccatattaccgtggaaggcaaaaaccgtacggtcgtccatgccggcaataaattctttagcggcctggcggatcgtatccagattctcaattttgattatactcatgatgtctttcgataatgttcttttgttatgttcgcaaaggtataattaaattgacaattgataattcactatcgataattatttagggatcatggtaatgaatggcaccatcatttcctccatggagattcctccgtgctggaatgtattcttataataagatacataataattatagttgttcgggtaagcgaagaaatcgtcgttcattgcgaagatatacttactgctcagattaggagaaggaagccccaccttttccggatcgcgtacttcgaatacttctttcgggttgtagttgaggtttttgcctactttatagcggagattggtgtttgtattcctgtcgcccaccacctttataggattatctacgcggatcgtcccgtggtcggtcgtaacgatcactttatatcccttatcggatatacgcctgaacagctccagggttgtagaatgctggaaccacgaacgggtcaggctacggtaagccgcctcgctttgtgccagttcgcggatcatcttcatttccgtacgggcatgcgacagcatatccacaaagttgagtactacgacattcaactggttatgggtcagcgacgagatcatattcagtagcttttcgccatactgcgaatcgtgcactttattataagagaatgtatatttcttacggaaacggtctatctgtgtctggatcaacggagcttcattgaggtttttcccttcttcgctctcctcgtcaacccacaaatccggaaacatcttttctatctgcaaaggcatcaggccggagaaaatggagttacgggcatattgcgtggcagtcggaaggatactgtaatacagcccttcatcgaaggtgaaatattcagccagcagatcctttactacacgccactggtccaaccggaagttatcgatcaggataaaaaaaaccttttcatcgttatccaataacgggaatacttttttcttaaaaagatccggactcatcaaagggcgttccgccggattctgtatccagttcacataattcttctttacaaacttaccgaaagcattgttggcctcttccttttgcatgcggagcatatcagacatctgggcctggctgctttcgagctccagctcccagtaaaccaactttttgtagagttccatccagtcgtcggtagtcaacgaatcgttgatctgcataccgatacggccaaactcctgctggtaaccgacagtggtcgtttccgatatgattacattcttatgtacattcttcttgatggaaaggagaagctggtttggattgaccggcttgataagataatcggcaatcttattcccgatcgcctggttcataatgctttcctcttcgcttttggtaaccatcacgaccgggacattcgggttgatctccttaatgtgggcaagtgtttccagaccagtcagaccgggcatgttctcatcgaggaaaataatatcgaacgattgttccttgcaacagtcgatagcatcctgcccgctgattaccggaacgacttcatatcctttatcctgcaaaaacaaaatgtgaggtttcagcaaatcgatctcatcatctgcccaaagtactctgtctttctttactgccatatttattaccttattaattcttacaaatttaactggaatagtttacataataacggtctgttggggcgttttgtatattatccgctgtttttttacggtcttttataccctgtgtattaaaattgtgaactgtgtttttaattctttttcatcgtatagtctgtaatccctaaagcctcgtaggcctgaagcaatgcctcatcgttgtcggagatcatcagcagtttatcgccctccatcagaaccgtatttcctttggggataaaataacgcccgtcgcgcatcaccattaccgccagcgtatggtcgggcagggtaagctccatcagcttgttgccatgcgtcaacacttctggtgttacatcgatctcgctcatggcactctttataccttccggcagctcgatgccgaatacatccttgcgctccggttcatcgatcaatcccagccacttggcggcctgtgttacggtcgttccctggataagcagggaaaggatagtgataaagaataccacattaaagatcaatccggcatgttctactcccgcaatcatcggataggtggcgaaaataatcggcacggccccgcgaagccctacccacgaaatatacaattttcctttcgtcgtaaagttcttataaggaagcaggcaaaggaatacgctgatcggacgagcgaaaaggatcataaagataccgactgtcagcccgatcggggcaaccggcaacaattcgtgagggttaacgagcaatcccaacgtaaggaacatcacgatctgccacaaccaggcaaaaccgtcgaagaacgtaccaatactctttttatgaacaatcttggcatttccaaccaccagccctgcaatataaacggccaggtaaccattccccttgcacagcgttgttgctgcgaaggtgaaaaaagcagtggccaacaataagatcggatacaacgactcgttgtcgatatcgatcttgttgatgataagtacggctaatttacccaacaggaaaccggctatagcgccgaccgacaattggataatcagcgatagaaccgcatcacccagattcatcccggctgtttgtatataggcgatcaacagtaaagtaagcatatatgccatcgggtcgttactaccactttccaactccagcgtgggacgcaaacgttgtttcagataaactcccttactccggagaatggagaatacagatgccgagtcggtagacgacataacagccgccatcaataacgattcgggaaaggtcagggtttcataccccacaacaaacttcgatatataatatatgaagcctcctgtgataaacgtagtagccaacactccgatcgtggccaggatgaccccttgcgacgcgattggcttaatctcggatatcttcgtgtccataccacctgaaaacaggatgatactcaacgccagcataccgataaactgtgcaatattcgggttactgaactggattcccagcccgtcactaccaaataacataccgactcccagaaagagcaacaaagcgggaagtccgaagcgataacctgccttaccggcaaaaatactgaaaaataaaatgacggaagcaatcagcaagattccctccgcattatgcagaatttctaaatcatggaacataagcggaaacggtttactctaattatccttcaaaataacaaaaaaaagctgaaacgacaatggaatgaatgccgaaatatctggctcatatactgactaataaatatattacgtatatttgtcgggataaaattaacactatgcataaaacacaattattcgcactattgttcatgcttctgatagggacagcatgtaacaaacaacagcacttcatctctgacaatgcattcagggcggaagtagaaaaagatttccaagccaaacaggcagctttgcctgacggagatctgttcgcagttttcaatcaggaaatgacaccgcaggagaaggaggcacttaccttcctgtatgcctacatgccgattggtgacatcaccgactatgacgggaaactctatctggataacatccgcagttctttccaggccaaacaggaaatgccctggggcgacagcattccggaagacatcttccgtcattttgtcctgccgatccgtgtgaacaacgagaatctggacgaaagccgcatggtctttttcgacgaactgaaagaccgtgtaaaaggaatgtccctctacgatgccgtattggaagtgaaccactggtgtcacgaaaaagtaatttataccccttccgacgcccgtaccagctcgccgctggcttctgtaaagacagcttacggacgttgtggtgaagagtcgacctttacggttgccgcacttcgctcggtcggtatccctgcccgccaggtatacactccgcgctgggcacataccgacgataaccatgcctgggtagaagcctgggtgaacggcaaatggtacttcctgggtgcctgcgaaccggaaccgatcctgaacctgggatggtttaacggcccggcataccgcggtatgctgatgcacaccaaagtattcggaaaatacaacggccccgaagaagtaatgctggaaacagacggctacacggaaattaacgtgatcgataactatgccccgacaggcaaagccatcgtaacgattgtagatgcggacggcaaacctgttcccgatgccgatgtagagttcaaaatctataactacgccgagttctacaccgttgccaacaagaaaaccgatgccgaaggaaagaccttcctgactgccggtaaaggcgatatgttcgtatgggccaccaaagacggtaagttcggtttcgataaagtatcgttcggtaaaggcgatgtgactatcaaactcgacaagaaaccgggtgatgctattgaagctatcgctttggatgttattcctccggtagaaggatctatccctgccgaagtaactcccgaacagaaagaagccaacgccgcacgcctattggaagaagatgctatccgtaataaatatgtagcaaccttctataccgaagaaaaagcggaagcactggcaaaagaactgggcatcgacccgctgaagacttccgactttatgatcggcagccgtggcaactggatggagatcgaaaagttcctgcgcgaaactccggccgacaaacgcccggtagcgatggcactcctggatgtaatttccgccaaagaccttcgcgacacaccggcttctgtcctggcagatcatctgaacaacaccgaagttgttaattccgaccaattcaaccgatatgtacttaatccgcgtgttgccaacgaattcctttcaccttaccgtagctttttcattgccaacatagacaccgaactggcaaaacaggccaaagaagatccgatggcattggtcgattgggtgaagaaaaacatcacgatcaagaacgaactcaactcgcaacgtatccccgtcatgccgatgggtgtgttcaaatcacgtgttgccgataccggatcacgcgacatcttctttatcgccgtagcacgtagcctgggtatcccggcccgtatcgaaccggtagcccgcaaggtgcagtttatgaaagacggcaactggatggacgtagacttcgaagcagctgtccagaccactgcaaagcaaggaaaggtaacggctacttatgccccgatcaaagcattgcaggacccgaaatattacagccatttcactattgccaagatacttccggatgctaaattacagacattgaacttccgcagtgcaagtaccgacatgggcgtaggtacaacctggagcagcctgttgaagaaaccgcagcctatcgacgaaggtaactatatgatggtgaccggaacccgtatggccaacggtagcgtactggccgaagtatctttcttcaacgtagagccggataagacaacggatatcaaacttgaaatgcgtgagaacctggaagaagtacaggttatcggtaatttcaactccgaaaataaattcaaacgtgccgacaacggtgaagaaaccagcgtactggctacaaccggacgtggttacttcgtagtagctatcctcggagcccgtcaggaaccgaccaaccacgctatgcgcgacatcgccgccgttaagaaagaccttgaagaatggggacgcagcatggttctccttttcccggatgaaaaaggttacaacagcttcgatccgaaagagttcggcgacctgcctaacacaattacatacggtatcgactcagacaaccatatccagaaagagatcgcatcagccatgaagctacagaatgccagccagctgccgatcttcatcatcgccgacaccttcaaccgtgtggtattcgtatcccagggatacaccatcggcttgggtgaacagttgatgaaagtgatacacaaactgtaagagacttatagtatataaataatcagccccgactgccggtatgtttcaagctaccggtagccggggtttttatttggcatatcgctccggctccatgccgacaattcgatatcgctgctcctataaaaaggttttgccatagtagtggcagagccttgccatgcctttggcagacttttgccactactatggcaagactctgccaagcgcatggcaaaacattgcgttttaaatggcaaaagattgccactacaaatgaaaagcatcctgctcctaattcattataattatattctatatatcgctcttctccccgtactctttgatcttctcttcacagattcgtttcgtaatatccctaagtaatttgacttttgggataagggcatccacatcctcttttgtaaccacaaaatatggattgtaacgagcttctacataggctgattttagcaaggtaaaaagtcgtttctcttcaagagtgttttgtggaaaaacagtattcaaatcaatagaataccttttagtggaagaagataacttagaaagattgtgttgtttgttattacgtaaagtaaaagtcaaacgaatggcataataaaagttttcacaggcttgatgtaaataaaatgatgacatttgatatctctcccttcctttattcgttacagcatcatccaaaaagaaatttcctttttcaaacttctcatcaaaatacacctgagcctgctcctttatctccgcaaagttaagtttgcgacgacgagccaacttatatttcccgctgttatacagaactaccccttcctgcttaatttgagtatagaaatatcgtccctcttctaagtatttattaagcaacttaatatcatcgttgataaactggacaggagtgtcgcggtcaaaatcctttccggcgaaaaagacatcttctacgttatccagaactgtttccgccttcttactgttgataccgctcgttaccacatagatatcataatcggatattttaacggtaggaataccgccatcttcaatccggacactgcgccgcacataattacctctagcataactgccatacagaattataaactccgtctgaggtaatcgcttcaatatctctttaacgagaaaatccaaatcttcctgtttgtccttgggcagataagctatcgagtttttcattatgcctatgtataacattaaatacgcaaatgtataaaaaaagcgggattggcttttactttttaatcctaaatcatatatttgcaccacgttcctgtttttatttgttttgtttgccaatacaaaacaaatgagtctgtataatacaggtaattagaatcttataattattaatatcgatctgtttctccgaatcagatctaaaaggaacgtactatatggacaacaatagaactgttgggataaatatttattccatcatacttcaacaaattatctccctattaaacctgtcattatcagatatcagacagaaatatataaactatccgcactgtctgatggattattttgagaaagagactgaagaaaaatcaatcgaaatacggtttgatcaggaagaaatcacgatcacctgttcatttaatgaggatagtaaatgtacattcatatatttattcacagataaatacgagttcatagaagagtttatatcttttttgaaagatacatacgactatgactttattaaaaacagatggagagagcccacttgttatatacaagtgaaagagatcagtcatttacctaacgacatctgcctgatattttattccataatacaataaaagcgacaagcaacaaaaaaatcctcccgaacgaattcggaaggattttgcattttgtgcggctgaagggactcgaacccccacgccgtgaagcaccagatcctaagtctggcgtggctaccaattacaccacagccgcatttggattgcggtgcaaaggtaattcttttttattaatttgcaagtttttcagaagacattttattttttcggcttgcaatcggttcggagatcggataaaaatgccatattgttgcctctatatccggatcaataccaaactccatatgttcttctttatcaacattcaatcatggcctatttgtcaaaaagcttcatctgtcccgttatctcatcgataatatccgagttactctgatcggctccggcatctgtctcttcttcctccggaccgatatcaataccttccccggccggttgttccgatgaagcgaaccgggtcggctccaactcattgacagtttcaacctcaaaggtcgagattcgttttcctttagctttgaaaccttttacaccgataaattcttccgcatcgagcaccatcgcttcacggaaactgtcatgtccaccgaatatgacttcaatacggggatacatttcgtcggtaagcaataacagacggctcttgggattttctcccaggaaattctgcttacggctgccggcttcaagctggaagcgtttgaggtaaggatatttctggtcggcatcatacaaagcagccgtccagaccttattggagtcgaatttctcaatgatctgtatattatcttcgtagtgattactaagatcaaagttggtcgtatagaaatcgccgttacgcaaaatcaccaggatcacatcgtcgctctggaattcacccagctcatcaccgcgtccgtcataattcaggcgcaatacatcccagtcgaaccaaacctggcgtcctccgagggtcgaactacccttctgtttcaggctgatcttatgcacatcggctttcgtaaggatatttcccatcgaaccacgccccttgatggcgatctcactgaaatctttctcaaagacgagcaacttctgacggggtttcggcttcagtattactttaaccgtttctgcttcaccattcggattggcactgaaatagagcacgcgcgacccttctgttccctttgttacatcgtattccttatcgcgtgtcactccggttacggcaaaacgcttaatgaagttataaccggcttttccatcccggtaaataacattataaatcgtacggttatcgttgcgcttgaatacattcaggtacaatacgtctttaccgacaaacatcttatcgcagactttcacgatcttataagttccgttacggtagaacaggatgatatcgtcgatatccgaacagttacaaacatattcgtcctttttcaaactcatgccgataaagccttcggcacggttgatatatagtttttcgtttgcttccaccaccttggtagcttcaatcgtgtcgaagttacgcacctcagtcatacgcggatgatctttgccgtatttttctttcaacataataaaccagttgatggtgtattctacgatattgtccagatgatgattgatccgttcaatctcttcccgtatctgtgcgatcagggcgttacttttttccgagttgaatttgaggatacgtcccatcttgatctccatcagtttcaggatatcttcgcgggtcacttcacggataaagtccggcttaaacggagtcaggcgcaggtcgatatgagcgatcgcttcgtccatatccttcgcattttcaaattccttatctttatagatacgttcttcgatgaatatcttctcgagagaagcgaaaaacaacgtttcttcctgttccgatttatggatctccaattcggtacgcagcagatgcaacgtatcatccgttgaatggcgcaacacatcactgaccgtgaggaagtgaggcttgttatccataatcacacaacagttcggcgaaatactgatctcacaatccgtgaaggcgtacaaagcatcgatcgtcttatccgacgaaacgcccggagcgaggtgcaccaggatctctacgcctctggctgtattatcgtctactttcttaatcttgatcttccctttgtcattcgctttcaggatcgactcgatcagggaagaggtcgttcttccataaggaatttcactgataactaatgttttgttatccagctttgttatcttagcacgaacttttacggagccaccgcgttcgccgtcgttgtatttcgttacatcgatgaaaccgcctgtctggaaatcagggtacaaagtaaaatcttcccccttcagataggaaacagatgcatcgatcaattcattgaaattatgtggcagtatcttggatgaaaggccgacagcgataccctccacgccctgtgccaacagcaaagggaattttacagggagagtgaccggttctttgttacgcccatcgtaagaaagctgccaggtagtcgtcttgggattgaatacggtttcaagagcaaacttagaaagacgtgcttcgatataacggggagccgctgcaccgtcgccggtcaggatgttaccccagtttccctgacagtcgaccaacaagtctttctgtcccaactgtaccagggcgtcgccaatagaggcatcgccatgagggtgaaactgcatggtatgaccgacaatgttagccactttattataccgtccgtcgtccagacgcttcatagagtgaaggatacgacgctgcaccggcttcaatccgtcgttgatatgcggcacggcacgttccaggattacatacgaagcataatccaaaaaccaatcctgatacatccccgaaagatgataggatacgcgaccttccccttttccgggtattctatattccgaatgtgtagcagcatcagactgctcattgggttgagaatctgtatttgtttgctctatttcctcgttttcgttttcctctgtgaaatcttcaatatcctctggtttcataaacttatatggtgctctttcttctttttcagcctctaaccggaaaactatttccagcgtgtaaatatacgaaatattggcgagataataaaaatccacaattgtttcagcgagatatctgatttctccctatatttgccccttcaaaaatacgatcatgctcacactcgataagatttatcaggcatcttttgccctgaaaacggttatccgtcgcacggacctgatcagtgcacccaatatcaatccggagtcacatatctatctgaaaccggagaacttacagatcacgggatcatttaaagtccgtggtgcctgcttcaaaatctcacaacttacggaagaagagaaagcaaaaggcgttgttgcctgttctgccggcaaccatgcccagggagttgcactggcagcgaccactcatggcatccaatctcttatctgcttgccggataatgccccgatctctaaaatagaagccaccaaatggtacggggcagatgtctgcctggtagaaggcgtgtatgacgacgcttaccagaaagccttaaaattacgagatgaaaagggatatacctttgttcatcctttcgacgatgaagatgtcattgccggacagggaaccataggactggaactattggaacaattgcccgacctggatgccgtgatcgttccgatcggtggcggcggactgatctccggagttgcttttgcaatcaagcatttgaatccgaatgtaaaaatatatggtgtacaggccagcggtgccccaagtatgcagaactcgatcgaacataacaagattgagcgtatgggattcgttcgtaccatcgccgacggtattgccgtaaaggagccgggcgaacataccttcgagtactgccgtaagtatgtggatgaaattgtgacagtcaatgatgacgagatatcgacagctatcctggcattgatcgaacagcataaactcattgccgagggtgccggcgcggtagccgttgcagctgcgatgttcaacaaagttcctatcaaagggaaaaaaacgatctgcctgatttcgggcggaaacattgacgtaacgattctgtcacgtgtgataggacgaggtttacagaaatccggtcgttcttacaccatgaccatcgaactggtcgataaacccggacaattgcaacacgtttccgagatcattgccagcacaggcgcaaatgtagtatcggtccaccatgaacgggtaagccacaccgcagatattaacggttgttacctccgcctggaaatggaaacccgtaaccaggaacatatcgaccagatacaatatacgctgacggcagcaggatataaaatcattccgggataagtaaggattttcatcaaaaatgaacactattgctcctttaccgatattgtctttatccacttttaatattttctttttttaatctcacaaattttctttttatttgtgccgtaatatctatttacgaaggggataatgagtatgaaaaaacaaattaaggaagaaatagaccttctttacaagacatatgtaaatgatcttttttcatatgctttgaacctgggatttgaccgggatacatccatggatgctattcatgatgtattctataaaatatgctcggatgaaaaaatacttgataaaatcgtcaatatacgtttttatcttttgcgtgcattgaaaaaccgcctgcttgatatttataaacaaaaaagggacgttgttgaattttctacagattccgaaacagaagaaatccccttcaacattcacgtaacagtagaggatctcatcattgaagaagaggaacaggatatagtccgcgcaaaagtagaacagctacttgaaagcctgactgaccgtcagcgtgagattatttatctccgttactctcaggattgtgattatgaagaaatagcacaactcatgcacattactgttcccgcttgtagaaaattgtttcacaaggccatcataaagttaagaaaaaatccatattccgccattctattgcttattttgctcaattgaatatttttttcaaaaagtagggtataaaaaaaattgttcatcgtctatatctataaacgagaaataaaactttattcataatccagctatactattaatatgacaactatcaaaaactataaagatttccttcagaatgccgatttcatcctttggaggttaacaggagacagctttctggaaacctactgggaagaatttattgaagagaatccgacattaagtaaggaaatgaataaggctattaaagaattttccaaaataaaactcaacaaaaacaccctaacagaaacagaatataatgcattactgaagcggatacatgtttcgtcatcacaaattaaatcttccaaatggttacgtcaatttataccatatgtagctgcagtctgttttactttgattatcgggatatcgttctattttataaagtcagcaccggaaaaaatagaattattatcagaaaacattattgtcggtgaaaatctggatgaaaaagatatctaccttattacagatgcaggaacaacaactttctcacagaatgtccacgtacaagtcaatgaaaatggatcaactatcgtacaggaggctgatggaaataaatctactatcattgaaaaagaaaaaagtacaatgaacaaattggttgttccttatgggaaacgatcaaaacttgaactttcagatgggacaaaggtttggttaaactctggatcaacccttgaatttccatctgtttttacagaaaaaaccagaatagttaacctgatcggagaaatgtatatagaagtcgcaaagaaccctctacgaccatttcttgtcaatacgcctgatatacaagtgaaagtatatggtacaacattcaacatttcgacctatcccgataacagtccgcaatctgtcgtcctcgtggaaggtagtgtcggaataaagactgaatcagataaagaaatacttctcatccctaatgaaatgtttgcttatcaaaatcacaaatggagtaaaagtgaagtagacaataccaaatatataagctggaaagacggatacattgtattggataaaacacctatcgaggaagttttaaaacaaatagaacgttattacaatctatccttcaagatcgataaaaatcttgatcttcagtcaaaaacctgtaccgggaaaatctatttatctgataatctggacaatatcatgacaacgatatcgttactttcttccacgggataccaacgagacgacaaaaccatttacattaatataaacccttaaaacaaatgcctatgagataatactgaatataacttacaaaaggaaatcggacgatactacgaatatcgcccgatccgatgacaattaattacttatatcagtaactaataatttaaaatcatgcgaatataagcaacatttttgtcatcagaaaaaaattagtgtcaattaatttcaatattaacctaatgctactattcttaatagcataaaaaaatcaaatatgaaataagaccaatagtaaacaggttgctattactacgaataatatcaacaggaaacaaaacgacttatatagaattactaataatttaaatcatactattttatgaattattctttatcggaggtaataaaagtacctctgcactataaacatatatacagaaaaatgaaagtatctgtcctaataatgatagccagtatatgttttgcttcagccaataacatacactcacaaaaagccgggctctctttccatttcatgaatacaccgattaaacaggtgataaatgaaattgagaagaatagtgattatgtattcgtactcgcagataacataggtaaggaaaccgagaagaaaataaacataactgttaatgacacgaatgtggaaaaacttctcgattctgtactggcagaaacaggtctgtcttatcggattatagacaagcaaatcgttatatataagaataagactaaaagaggaatacctgagaaaagatcaacggtagaaacgaacactcaatctgttaagatccaattaaacggaaccgttacagataccaacggagagccgctaataggagtcagtatccagttgaaaggaacaaccagtggaacagtgagtgacgcgaacgggaaatattcgttagaagcagaagctggaaatacattgatcttttcctatgtcggttacaccatgcaagaggtccgtgttggtaataaatctgttattaacatacagctggcagaagatacacagactctaaatgaagtagtaatcgttggttacggtacattaaaaaagaaagaagtaacttctgccgtggaaacgatccgacctgacaaattcaatgccggagccagccgtaatccattggacttgatccaggggaaagtggcaggtcttacaatgacccgtgcatatggaactaacccgaatctggatccaagctaccagttacgcggtgttacttccatcagtggaggcaaatcccctctgattgtgattgacggcattcccgtcagttctggtagcggaagaggttatatgagcctggttcagcaagacgatatcgagtctttcagcgttttaaaagatggttcggcagcagcgatttacggaacacgtgccaatgcaggtgtcatccttatcacaacaaagaaaggaaaagcaggaacggcccaatttgactattccgggtatgttcagcacgaaatggtagcaaacaagcctgactttttaaatgccgatgaattcagaggattaatcaaagagggtataattaccggaaatcaggattatggagcatcaacagatctttatgacgagttaatcaataaaaacaattttagtcactaccacaatttatctgcatccggtggtactgccaacacaaattatcgtgcttcaatttacttcaatgaggctcagggtattgctaaagagaacgggaacaagcagtatggaggtagagtcaatatcaatcagaaaggtttgcaagaccggcttaccatgtcattaaacctagcgactaattttaagaaagaaaacaggaacggaggtagtggtaatgacttcgaacaagcgatccaacggaatccgacaatgcctctttataatgaagatggttcattttacgaaatagttgtttcaaacagctacaatcccatgtcacgccttgcttatcgtaccaatgaacgcaaccggcagacaacatcagctgatctaaaactaaaacttgatatcattgaagggttatcagtctctgcctttggagcacatttgagagacaaccacaatgagcgttattatcgttcatccaaagattttgataatcgggttggtacgctttatcaaggaatgggatacgcctccaaagcaaacttgcttgaatggaccaataccttcgaatcaaccatcgactaccgtaaaacatttaatgataagcatactataaccggattgctgggatatagttaccagtattcgactacagaaacatttagtgcgaacaacaatggatttacaactgatggatttgaagattggaatttaggtgccggtagtgctattcaaaacacaagtctgccacgtccggaaatggccagtgccaaagaagataataaactaattgctttctttggtcgggtaaactattcttacgccgataaatatcacttccaggctattctccgtcatgaaggatcttcccgtttcggatcaaatcataaatggggaaattttccctctgtatctgccggatggtcaattaatgaagaggaatttctgaaatcggtatccttcattgatgaactaaagctacgtataggatatggtgtaacgggtaaccaggatatcagcaactacctgtctcttgtcacactcgaaactggaggtgtctatccgcaaaacggtatctattaccaaacttatggcccaggaagaaacccgaatccggatcttcgctgggaacagaaaaaggagctgaactttggtttggactactcgttactaaactatcgcattacaggttctattgatgtctacaatcgaaccacacaagatttgctctataaatacaaagctcaacaaccatcatttgtacgtgatgagatttttaccaatgtaggttcgatccgcagttccggcgttgaaatccaaatatcagcgactccccttgaaggcaaagatttccaatggtctattgatttagcagccagcaccggttcgaacaaacttacaaaactctctaatgaatttttctcactgggctccaactggttgtcattgtatagtcttcctgcccctggtgcactgggatatgccattcgccttgatgaagggggcaaaatcggtaatttttatggaaaacgttttgctggtctgacggaagacggaaaatggttattctacaaagcagacggaagtacagcccgtgcctctgaaatgaacgagaatgataatactatcattggcaatggtgttcctaaagcacaagtatccttaggtaatacattcaggtataaaggatttgatcttaccatactgttaagaggtaaattcggtttcgacattttgaatctgccagatctttacttcggaaacaaaaaatggctacctcagaatttgttaaaaagtgcaatcaccaaacataatgatctgaatgatgatccgcagtattcagattattacatcgaaaaaggaaatttcgtgaaattagacaatctgactttaggttacaatttcaaactaaaaactccttatatcagaaatctgaggatatatgcaactggaagaaaccttttgactattaccggatatagcggtgtcgacccggaaatacaagataccggtatcgaagatccaggtattgataaaagagacttttatcctagcacccgctctattgcttttggtttgaatattggattttaaatttgaattattatgaaaaacaaaattaaaaaagttactttatttattgccgctggaataattgccacaggcataaatagctgtactgatttggacgagaaaatctatagcgaattagataaaaacaatttttacaataataaagtagaagtcatgcaatctgctctgagatcttttactcacttggcagcatggatagcaccaaccggatggagtgcctacttttatcattctgaactttcttctgatcaattggcatggccacaaaaaggacggcacggatatgatggcggtgaccatttccgtcaacattatcatacctggaccgataatgagagccgtatgcgtacggcatggagcctgatgtggaccggagtaggctatatcaattcatccatagccgatttaagcgggatcaattatgcttcgttggacatatccgacagcgagatggaaacgattcttgccgaactttacgtattaagagctttccattatatgaaaatcatggaactttggggtaatgttcctattgtgaccactgtaggtgaacctttgaatccacccacacaatcacgggatgaagttttcgcatttatagaaaaagagctcgaaacgtacgtaccaaaactccttccctactcacaggaaatagtcggacgagtatcacaaacagcaggttatgccatgatggctgaattatatctgaacgcagagtattttgtaggtactcccatgtgggataaatgtattgctgcctgtgataaaatcataagtggagaggccggaggacttcataatggtaaagcagagttagcagacgacctactcgataccttcgacaacacaaacaaagatgctaaagaagcgctgtttcaattagcttatagtcaaaaaggaggcttcgcattcaactggtcaggattcttctgcggatttagtaatacaggtccaatcctaaatgtaacctatgatggatggaatggatttgttgttatcccttctgcatttgacgcttatgctgaaaatgatttacggaaaaaagaatggttcctttttggcccacaatttaaatatgggaccgatgagcctgtttacggagtggaagaatttaccggccaacaattagtatatgtaaactctattcgccgtgaaagccagggagactttaccagcgaaggaggaatggatcagggagaagaaaatagtggtgcccgttttaataaatataaaagcggaacggtgaacgatccgaattactgggagaaccattatatactttatcgtcttaccgaaatctatttctttaaagcagaagcgcttatgcgtaaaaatggaggtaaggcatctcaggaagccgttgatctcgtcaatgcttcccgcaaacgtgcttttacttcggaagattgggaagcaaaccagtacacaaccactacactgactttagatgagttacttgcagaaagaggcagagaatttatctttgaaggaaaacgccgtacagatcttatccggttcggaaaatacacaacagctagttggtgggatcataaaccaagtaacgacaaaacaaaagagctctatcctatccctttccagcagattgaaaccaaccccaatctgatacaaaatccgggatattaaatgattttcttttaataaatcaaggttacaatattggcaatcaatattgtaaccttatacactatcggtttttattcaactaattcaataaaaatgaaaatgaaacaattattaaaaaaattgatttacgtcataagcttaatagggtctaccatattgatccaggcacaagaccaaacaaaagtcgattgggaacagatatcttatctattgggagaactggagacaatggatgtcgcatctgtaagattagccttcgaagagatgaaaaaatcccctggctatgatatagaaaagtttgaacccaaaatgcgggaactggaagcccttggaaattgggtccccaataggctcccggcaggcaacagctgggccataggaagagcaaagcgagccattgatcttcgtcgggaaatattattatccaatcctttgctggacaaggacaaaattatagcagtacgttatcgtctggggaaatcagctccctatgttatggcaccttctttgggaacacaacaggataactggaccagccagttctcagcctatcgcgaaggctacaatgccgagctggtagagatctctaatttgcgagaccccaataaagcgttgaatataagaactatttataaaccggagcatgatggtggtataacaaatgttgttctaaattgggatgcggagagaattctattcacagcaacagatactaataaaaaatggcatgtatttgaagttaaccgggacggttcaaatttccatcaggtgatcaagattgacgaacccgatctcgaattttttgatgcaacctatatgccaaacgggaaaataatagcaatgaccaatattggttatcagggtgctgcatgtgaagacggaagttatgaaacaggaaatatgatcgagtataatccagaaacaggagccatgagacgcttaacattcgatcaggatgataattggcatccacgcgtgatgaacaatggccggctgatgtatacacgttgggaatatacagatttaacccactactattctcgtttcgttatgcatgctaatccagacggaacagagacaaaggctttatatggcagcggaggatggttccctaacagtatttttgatgcagagcccctccccggcagaaacagtgcattcgttgccatagtttcaggtcaccacggaacagctcgctccggtcgtttaatgcttttcgatccgactaaaggacgcaaagaattggatgggatcatacaggaaatcccttttagcaaaagaccaatagaaccgttgataaaagatcagctagtagatggtgtatggccacaattcacaaaaccctggcctctggatgataagttttttctggtcaccgctaaattaaacctcaggtctccttggggtatctacttggttgatatatttgataatatgaccgaaatagctcttcttgaagaagacggattcattaatcccataatggtgacacagcgaccggttccccctattattcctgaaaaaataaacctcgaaaagaaagaagctacattcttcattcaggatatttatcagggagagggtttaccgggagtacctgtcggaaccgttaagaaattaaggatctttgcttatgaatactgctacgtaagaacaccgggaaaccatgcggcacaaggaatacaaagtggttgggatataaaacgccttttgggcgaagttgaagtcgaacctgacggctcagtaatgtttacagctccagccaatacacctatatccatacaaccgttggactccgaaggacgagctctgcaatggatgcgaagctggactaccggaatgccgggagaactcgtttcgtgcgtaggatgtcatgaaaaccaaaatacaattcccctccctaaacgggtaatggcttctacgaaaaaagctaaaccattagaactaccggaaggaggcacacgctcgattacttatgaactggaaatacaacccatattggatagagcatgtatttcgtgtcataatcaggacagtcaactggatttcagaggaaatatctacgtagagaatattcttacaaatcataaatcgaatcgagaccaagagctaaagacatcgaccagttatctgaatttacatccttatgtaaaccgtcaggggccggaagccgatatttatgtaatgaaaccttatgaatatcacgcttcaacaagcgagcttgtcaaaatattaaaacgaggtcatcataaggttgaattaacagataaagaatggcgaaccatttatgcatggattgacatgaatgctccattccatggtaagtttgtagataacttattacccggatgcccaaccaaccagtatgaccgtcgcattgaactggctaataaatatggaaatggagcaggtgttgactggaggaaagaattatctgattattctgactatctgaagcaaaaaaaaacggaaactcccctggttacacatacggttcatccgacttctgattataaagaagtaaaagtggaaggatggccttttacagcagaagaggctaaaaaaatggtcaatgcttctgaaaataaaaagaaagtagaaatagctccgggcattattataaattttgtacgtattcctgccggtaaatttgtcttagggaataacaaacaaggacaaaataacaatgcacctcaatctgaggttgaaataagcaaaccattctggatggcagaaacagaattgacaaatgaacaatataatgtaatttttccaaaacatgatagccggtatattgctcagttctggaaagatcatgttcaacccggttactcggctaatcgtcctaagcaacctgttattcgtatttcctggaatgaggcaatggaatattgtaacaaattaagcgatcagacaggacttcacattacattacctactgaggcccaatgggaatgggcctgccgggcaggctctgacaaagatatgtggtacggaccttatgatacaaactttgcgaattacgataatatggccgattcccaattaagtaatatggctgtatccggtgtagacccgactccgatgcctcatcattggaatgaattcaaatggtataattttataccaaaagattcaaccgtaaacgataggaatatgatagttaccgatgttgcaaaatatcaacctaatccatgggggctttacgatatgcatgggaatgtagcagaattcactcgttccagttatgcagcgtatccatataatccaaatgctcagagcgatcttaaagtctatcgtggaggttcatggatcgacagacctaaaaactcaacatcttattccagaaatgaggcttatgcctggcaaccattgaataaggttggattcagattgataatagaggattaatgataaagtgcagaaaaatgcagactatattgattattcataaaacaagtctgcgtttctctgcatcttctgcattcggtttaagtatgtgaatgaagtcataaccgccagtgacgatataaagattataaaacgactttgccttcttttcccatttcaatcaccatctttcctcctttcaatacctcttcttgcggaatccggaaaccatttaccggtttaccgttcaaggtaaccgattgaatatatttattctctttggatgcgccgggagcttctatcacaaaagtctcgccgcggttatattttccatccagccggatcgtgattttgggatagcgcggagaagccaattcatagtatggcttttcagagcatccgccatccatctgaaacaaaccgagagcactcatgacaaaccagctactcatctgtcccagatcctcatcccccggataagcgtcgtaaggggttgttccgtaatactgctcctgtatcgcccgtatccatttttgcgtcagccagggagcacctgcccagttaaataggtaggcaacttccatagatgtttcatttccgtggttgatagggaaagcggaaaagttatcgcctgccgcattaaaattggcatgcgccgactgctccatcgctttatccaaacggcttataaaacggtctttaccgaccataccgatcaatttatccggattatggggaacgaaccaggaataattgaaggcatttccttcggtaaacccgggtgtatgatacggatcgaaaggctctacccagttaccgtgttcgtctttaggacgtataaatccggacttcggatcaaacaaattagaccaattattcgaacgttcatcaaacagtttaaagtcatcggtctttcccaatactttagccatctgtcccagacaccagtcgtcgtaagcatactccattgtattagagacagttcctttccctgcgggaatatatccatacttcatataaggaaccaggttctcaactccgacagttccaccaccttcatacttctgaggaggtgttgtcatcatctttttcagaccgtcatatgcaatattcaagtcaaagtcacgtataccgctttgccaggctcccagtatctgggagatcggatgcatggcaaccatcacaccggtatgttctatcccggcaggatccgtattgaaccacccgctattctgataaagctgaatagccgaacgtgcccacttgccggatatttccggagccatcagattgaataactgttgattattccagaatgtattccaatattcaccgctcacgatacaatcgtccggtttctccaactgcctgatcctttcatcttcatccataaaacgaccgtcggcatcgctccaggttgctttggctgctaacgcacggtaaaggttggtatagaacttcttcttttgcagataatcatccgtttcaatcgctattcttcccaggtattcatcccagacggcacgggcattgttcactactttctcaaaatcccatccaaaaggatcaaccagttcctgtttcaggttattccgtgcccctgccatatctaccagagaaacaccggaacggactaagatttcttcattctctttcgtcttataattcagaaatataccgacatcacctttgccttctatcctgatgatattctgcttgatttccgcaagggtttcaaactcgtgattcctgttccatccggggatataaccggttaccggctgaacgccttcgttcacccatccgcccatcgagtcgaaaggtttgctgaactggagaacgaaatacaatgtataactctgttccaatgtatatccggtaaatgcattataataagtagcataaccttctatttccgtatcgctgactttcgttacacaggcattgaccaaattatgcgggtactcgttaggcgtaaacatatctatcaaaatacgggcgtcttccctggcagggaaaatatatcgctgcaaagctgcacggcgggttgccgttatatccgcttgtatcttcgtatccgtcatataaacggaatatttacctatttcagccttttccgatgatttgtcaatccgggaacgatagccttcatcaggaaaatcttccctgccgggattgactttcagttcaccacaggtcggttgcatcaggaaaccagtcatcgtccaatcgctgaaatggttgaagcccatgatattttctatagtatattcatatccggctttccatatctcgtcctggttatcgggagcgatctgcaccatgcttaaagggagacttggcccgggtttgaacatccaacgggaattccccgtgcccatcagcaagtctacatcatccgaataagaatgcagcggttgtgaactacggatcacttcacctttataaataacatctttgccatcccggattgtaaattgcagcttttcttgtttgctttttacctgtgcggccggcatcaatatctcctggatactttcccccacctcaatcgttcgtgataccggaacacatccttcaaccgtgaaagtcagctttttgggtgcatcaaactgattcatatctaccagaaccggctgcatacgttctccgttctctttctgatattcaaacggtgccgatttaacggaacgtatcaacgaagaagacgctttccccagttgtacagaggccggtgtttccaaccggatacaatcgaaaataacccatgtgcctttaatggtccccagctggatcttattcataccggaagtaagccatgaagaagggaattgtatatgtacctccttcgcttttcctgttcctttattttccagaaactccgcagcactctccccgttcagttcttcttcgaaccgatggccgttgacctcgacccgtattttaatcggtttactgttatgcgctccggtaaaaaagaaagtaagagaacattcccctttcccggccgctttgtccagattgaaatagacagaagggaaatgtctcggatgaaatccggcccagtatccaccgccagcccagctatccaatggacccggcaaaacatacggccaatgtttttcaggagtagaatatcctacataaaaggatttctctcccccgaaattcgccagaaaacttttgtaattatccggatagagggcaaactccgctgcggaattgtcctgtcggcctatttcgaacaacactttatcggtagcaaagagtttcaaggaacaaaagataagaatgaaaatcagacatatacttctcatggtcttcttaattaatgagttctttttcagaaaatacaaatatatggcaccttatccagccgatcattatactattcactgattttattggatagaattattctgtcatctacagattatagggcacaaaaaaagcactactcatgtagtgcttttttctattctatcagttttttgttatacattataatactcttcccaacctttacgcggcggttgtcccaccagcatttgattagcgaaagagtcgtttacaatttcttttgtatcacgatcgaaaaccagtttacgattcaaatgctgagccagaacacccaggcagaacacctggcttaacggaccagcaatggagaacggcgaacgggtcttttctttaccctggcaagccaacaagaagttttcgtaatggttagacggacttttttcatattccggcagtttcggattcatatcttttgcaatctgatccggaataacagacagtgtactaccatgagaaccacccttaaatgtaagtgtctttgaatagatttccttacctggattcagtttcatcaattgcagtttaccaccggcaacggtcggaatattcggatcgacatcagatgagccgaagttctccggaactgccggaatattatccaaaccatcataccaggtaacatctacagccggcatattattcctttcggggaatttaaacagaatggtagacgacatcggatagaaaaatggattatggtctttcagatataacggatttacttcggaaggcaagcccaaatccaggaactcgtgagccgtatccagaatatgtgctccccagtctcccagcgcccccataccgaaatcataccaacaacgccactgtcccatatgataatcatgattataatcatgatgctgcactacgcccaaccaggtatcccaatccaatgtttccggaaccggttcacccatcggcatatgcttgatgttcggattccatccgtgccaacggcgcggagagttcatatgagctgtgatggcagttacatccttgatcaatccggcctctttccaggctttgaactggaagtaatttgcttcggagtgtccctgattacccatctgtgtaacgacaccgtatttcttttcgcctttcatcatcaactccacttcatggaaagtacgggccatcggtttttcaacatatacatgtttgccatgagccatagcttcgatggttatagggaaatgggcatggtctggaacccccaccgtaacagcatctatcttatctgccatcttatcgaacatctggcggaaatcctggaagcgttgagctttcgggaacatagatataagttcttgcgtatgcttagctcccatatccacatcgcaaagagctaccacattacataaacctgttttatacaactccttggcaatctcacctccccggttaccaatgccaataaacgcaatatttactttttcgttaggactaacgaaaggtacgccaggaaaggcattagcctttgaaggtatccaaaacgacgggatagccgtagctgcagaaagagccaatgcccgcttcagaaacgagcggcgtgaaatgtcttctgatctcatggtattttatattagataaattaagtctgtttgcgcaaacatcaaaaacatcaactatgcaaaaatagatattttttgttgatatgaaagggtttatagaagaaaattcttaaattaatccaataatattgttatcatagaataattttatccgcatagtaaggccgattcttctttttgtttttgcctgtcgataattatgagcaggcttgttgataattgtcgacaggcttgcacacaattgtccgcaggtttgccgataattatcaacaagcgattagtttggaaaccgaatctgtttactacatatagtaaatcaactcacatcacatagtaattaccagatattctgcgttgtatggctatttaatgcctcttcaatcctctgcttataagcttcagctcctgccgctatatttctggaagcatccccactacccattccatagacaaccagcggtgtattccagaccatcccggcatgtatcgcacatccctgataaggacgcaaaagttcatccattgtaaaacaattccgtccaccactacggtaagctgcatactcagacccagttgtcgtgacgatctgcaacggtttaccggctacggcaggtgtcttcgccaacgaagtgaagacttcatccaaccacctttttaaaagagagggagcagacatccagtggaaaggaaactggaaaataaccatagaggcatcagaaataatagtgctccacacatttacatcaaaagattgatcccggtattcatataaatcatagagcattacaccatctatatcttgtaccgcatctgccaatgccttgtttgcctgtgactctttcaagttaggatgagccaaaagaatcactacttttttcgaaccgtcattcataatattgtattttatagtgtaaaagtgctgattgattattattttacaaatataaacaaattcataaatcactgataaaaaattaagagtcagattttcgtttttgattaaataacaatcactcccagataattgatttttgaaaagagaaagaattagagacggatcattgatttaacataaatatacacacatactttttcatataccgttgattaaaattaaatacaaatcagtgatccacaaatatatagttactttttgataattaaaaaaatgatattgttctagtagaactcattcgtaatttctgttaagaacagattctaagttaacattcatacttttgatctccttgaacaataaaccaattacaactaatttgttacaaaattaactcttttagcatatgctcccctcttattaacgaatttaaaattgatttagcctattttggctattgcaaactgctgtcattttgatagaattccatagttctactagaactacaacaactttaaatatgctaaaacaaatatacacacatctatttttcacttataaatcaaacgcttatgtctaaaagattaaaatttccgagcttgattttgcttgccggtgcattagtatctccttttggagtctatgcagacgtgttacccgacaagcaaagtgtgaacatttcccaacaaaacgggaaaataaccggaatcgtagaagattcaatgggaccggttattggagcttcaatcgttattaaaggaaccacaagtggaatcatgaccgacattgatggcaaatttacgctaaacgatgtcaaaagaggtcaagtgttacaaatctctttcgtaggatacaaaacgaaagaaattgcttacaccggccaaacaacgctaaaagtatttctggaagaagactcacaggcattggatgaagttgtagtaaccgccttgggtatgtcgcgtgacaaaaaatcattgggttatgccatgaccgaactgaaaggagatgaaatcgccaaagtaaactctcctaacccgattaacggtttgcaaggtaaagttgccggtgtacagatcaacatgggtaactccggtccgcaatcttcacaacgtatcatcatccgtggtaacacttccttgggaggtaacaaccagccgattttcgttatcgacggtattatcatcgacaatgaagtaacaaaaacaggggcaggacaagactggggtaatgacctgaagaacctgaatgccgatgacttcgaatcgatgtctgtattgaaaggtgctgccgcaaccgctttgtacggttcgcgtgcttccaacggtgtgatcctgatcactaccaaaaaaggtcgtaaaggtgaaggtataggagtttccgtttcacatacacagcaatgggaaaacatctatgcgacaccggatttacaaaacgaattcggttccggttcttcccccgtatgggcactgaatgacgatggcagtgaaaaccgctacacttctgccggccgtagcttcggtcctcgtttcgacggcaaaccgttctatgtggatggccaggaaatgatctattccgccaaagacaacaacttgaaaaatctttatcagaccggacactacatgaacaccaacgttgctttacaaggtggttccgaaaaaagtgcattccgtttctcctattcaaacctgcaatcagaggggttgactttcaacaacgaattcaagcgtaattcattcagtttaaacgcatcccacgatatcagttcccgcttgaaagcagaaggcggattttcctatatcgaatcgaccgcccagaacccgacaaggcagggaggttcaggctctccgatctatgacttcatgtacagcatcgcccgcgaatatgatacagattactggttgaacaacaaaaactatatcagtccggccggcgacggttataactcactggatccgtatggttattccaaaacgatctacgactatctggaaaacatctatacacaggacgaaatgagtgtacgtgctttcctgaatctggatcttaaactattggattggttgtcattaaaagtgaaaggcgatatttacaagctatatacaaccaacgaatcaaaagtaatggctacaggtgccagcaaatacgacggtgcggcatacaaaatccatgaaaacaagaaagaccagtacaaaattaccggtatgttgactgccaaccattctttcgatgatttcaatatcagcggtagcgtggcagtagaacagtgggataccaaaaggggataccacaaaaccaactcggaaaatggcttgcgtgttccaggtttgttcgatatgacaaactccgttaataaagcgacaaccgaagtcagatataatactgacagaaaacgcatcaactccatctacgcttttgccaatatggattataaaggcgtttatttcctggatataacaggacgtaacgactggtcgtctgcattgatctacgaaaacggaacaggacacacttcttacttctacccgtcggtaggtgcttcctggttgtttgccgaaggtttacgcgatgcgatacctgaatttatctctttcggtaaactgagagcttcctatgctatcgtaggtaacgactgtgctccttatctgacaaccggtacgggttattatgcattcgacaacacattcgacaaccaactcaacggtggtacttatccttattacaaattcgacaaagacgaattaccgaacttaaatttgaaaccggagaaacaacactccatcgaaatcggtttggatatgcgtttctttaaaaaccgtctcggcttcgactttgcatggtataagaccaatacaaagaaccagatcctggcattgccgatcgcatccgaatccggtgtttcaaaacgttggatcaatgccggagacatccagaacaaaggtatcgaattattgattaccggtactccgatcgaaacgaaagactggcgctgggatttgtctttcaacctgacgcgcaacagaaacaagatcatttctctgtttgaaggcgttgaaaaataccaattagtaggaggtggtacagatacacaggcatgggctaccgttggcggtgcttacggcgatatctacacttcttatgcctacacacgcaacgaaaatggtgaaaagctgttgaacgcagacggttcttatccccgttcaaataaaagtgagaaaatcggctctttgcagcctaaattcttatggggagccaatacttccgtaagctggaaaggcattacgttgaatgctgtcatcgacgctcgtttcggcggagatgtcttctcggcaagttattattatggtatgaattcgggtaacgttaaatcttcattggcaggccgtgacacacaatacggcggtttacctcgtacattgagtgacggaagagtggtcaatgacggtataattccggaaggcgtatttatccctggtacggaaatcaaaggggtagatgtttccggtaagagctatcagtatgcctacgatcaaggattggtcgacccgttatctgcttacaaatattatgacaacgtgtacagttggtccggaggtatccgtgaagaaggtatccacaaatgttcatggatcgcattgcgcgaagtttccgtacactggcaattgccgaaaaaatgggtgaacaaagcctacatccagaatgcaagtatcggcttaatggcccgtaacttaggattcctgtataacagtctgccggacaatatccacccggaaggtttgaacacatcttacagctctgaatatatggaaagcggtggtgccgtattctcacgcaacattggtttcagtgttaatgtttcattctaatcacctttatataatcaagtaaaatgaaaaaaattaaatattatattctcggagcgttagcttccatggctgcattaagctcctgcgatgccgacttcgttgaaatcaataagaatccagatacggtatatgaagttgatccggaagtattcctctatcagattgaaaatgtaatgtgtaatgccggagaaacatggtcggactcatatgcctgccgcttgagatggatgcagtattgcgccggaatctggggatatagcaccacgaacttcaccgaatgcgccggtttttccggatcgttatacagcaactatgtaaacgccggcaaatatgcccgtcatataccctattatgtcaagaccaatatgccggaacaggaagccgcttacagcgacttaaccgaagtagcccgtatcctcctgattacaaaaggtatccaagcatccgacgtgtacggttctttggtgtataccgatggctggggaacccgcaacggtaacgtggaaattcttgaaccagctttccaaactcaggaagagttgttcacgatctggaaccaggaattgaaagaggcggccaataaactgtcgacatccaccaaccaggtgactttcaagaattatgacctggcttatagcggcgacatgaacaaatgggcaaaagcggctaatgccgttcgtctgcgtatcgctttgagattgttaaaacagaaacctgaagaggcaaaagccattgcacaggaagtattatcttccggcaacattttcagcagcatcgacgatagctttatcctctatttcgataactactggacaaccctaggcgactggcactctgtcattgacatggaccgcgcttcttctgctttcatggcttacttactgaaatataatgacccaagaaaacgcctgtttttccaaatcaataatttgactccggaaaatgtagccgcattcaatgccaaagagacaacaactcctgcgcaaatcatcccgactcatttaggccggtgggccggtggtagtgtaagttacgacaaatgggctaccgattcctgccgcacatcccgttatctggacgatatcgacatgcgtccgatgaacagacctcaaactcgtttgtggaaaggtgcacaagacaatggtagtgccggtggctggattcctttagtgacatacgcagacttctgtttcatggcttccgaatttacgctggacggcgtagccaacagcaaaacagctcaggaatggtatgaagaaggagtaaaagcctctctgagacaatggagcaaaattgccgactactgcaaaatcaacgattacgaagctgtcacagaagcagaaatcgaagcattcctgaaacaggatggtatcgcatggaacagttccatggctaaagagcagatctactgccagacttgggtagaacatttcaagaataacagtgaatcatgggccatgtacaaacgcaccaactatccgagcactacatctacattggttacctgggaaccgatcaatgtatacggagaattgcagcaagtaccgcgccgtaaaaagttcactatgcctgccgacggttctgccaactatgccaatcaggtaaaacgccttgaagacatgcagaaagaatcgaacttcggtcgtctggacagcgagttcggtcgtatctggtgggataaagaataaacccagaactaaatattcaacataattattgatggtgaagggtgaccgggatggtcacccttctttatatgtattaactaataagccgctggaaatgctgtaacttacagaaaaaatcatttactttgcaggttgataataattacatatacttatggcacaagaagatgttttcaagaaattagtttcacactgtaaagaatacggatttgtatttccatcttcggaaatatatgatggtttaggagcagtgtatgattacggacagtatggcgtagagctgaaaaacaatataaagaaatactggtgggacagcatgaccctacttcacgaaaatgtagtaggtattgactccgctatttttatgcacccgactatctggaaagcatccggtcatgtggacgcattcaacgaccctttgatcgacaataaggattcaaaaaagcgttaccgcgcagatgttctgatcgaagatcacctggctaagatcgacgaaaagatacagaaagaagtagataaggcagctaaaaaatttggtgaagcattcgacgaagttcaattccgtgccaccaacggccgtgtattggaaaatcaggccaaacgcgacgagatacatacccgttttgcaaaagcactgaacgattctaacttcgaagatctccgccagatcatcatcgattgcgaaatagcctgtccgatatcaggaacacgcaactggacggaagtacgccagttcaacttgatgttctctacggaaatgggctctacagccgatggtgcttctaaaatatacctgcgtcccgaaacggcacagggaattttcgtaaacttcctgaatgtacagaagacaggccgtatgaaaattcctttcggtatcgcccagatcggtaaagcattccgtaacgagatcgttgcccgtcagttcattttccgtatgcgtgaattcgaacagatggaaatgcagttctttgttcgtccgggtgaagaaatggaatggttcaatatgtggaaaaagactcgtctgagctggcacaaggctatgggattaggtgaaaagaaatatcgttaccacgatcacgagaaactggcacactatgctaatgcagcaacagatatcgaattcgaaatgccattcggttttaaggaagtggaaggtatccatagccgtacggacttcgacctgagccagcacgaaaaattctccggtaagaaaatgcaatatttcgatccggaactaaataaaagctatactccgtatgttatcgagacatctatcggtgttgaccgtgtgttcctgagcgttatggccggttcatattgcgaagaaacacttgaaaacggcgaaacccgtgtggtattaaaattaccggcagccctggctcctatcaaactggccgtattgccactggtaaagaaagacggtcttcctgaaaaggcagaagaaatcatcaacatgctgaaattcgatttccgttgccagtatgatgaaaaagattctatcggtaaacgttaccgtcgtcaggatgctattggaaccccgtactgtattacagttgaccatgatactttgaaagataattgcgtaacaatccgcttccgcgacacgatggaacaggaacgtgtaagcatcgacaagttgcacgacattatctctgaaaaggtaagtatgaagacgttattaaaaaagataattgaataagtacatgaagaagtacctgcaaatcgcgttgatgattttttgtatatcggctgtttttacctcctgtaaagatgacgataataatgatgatgcacttgtcgaggcatataagttggaaaatgaacaagctttccaggcaaaagccaatgacccggattacatacaagtaaaaataactggtaatggagacggttttgtttacgctaaaaagctaaaaaatggtgatggtccggcaatctactttaacagccgcgttactgtttattacagaggttggctggccaacagtacctccgctgattatttcgataaatgcgagtttgaagatggggcacctgctaaatttgcagtaagttcctattcggcaaactacaatcaatataacaatcctaacggctattctgcaccgataacaggctggacaattgctttgcaaaacatggttgtaggtgataaatgggaagtatggattccttatggattagcttacggaacaagcgaccggaaagacaatgccggaaatgttacaattcctgcatactctactttagtttttgaaattgaagtaatggaacggactgctgaagtggcaggcactacttaatcgttattatacaataaaaaggagttgcgtcaaaagtcagcaatagttttttgacacatctccttttacatttcacaatcaaaatccgattaaccttttaatacgcaacaccttaaaaccgtctttatgagaagaatccactatctatacttgctaatgtttttctgtctgctacagcttgatgcaaccaacagaaagccattcaactattacttttcgcatatttcaagtaaagacggcctatcggaaagccaggtaaaagtcatattgcaggatagttatggctttatgtggtttggaaccaaaaacggattgaaccgttatgacggcacctccatccaaacaatcaactgtgatgactatattgccggcaaaggagaccacaacatttctgctcttttcgaagatgaaaataaaaaactttgggtaggtaccgatagaggtgtttatatctacgatccaatatacgatctgttcactttcatagacttaaaaacagaaaatggagaacagatggggaactgggttgctaaaatcatctccgatcgttcaggaaacatctgggtacttattcccgatcagggagtttttcgttataaagacaataagttatactactacgcaattaccaataaagataatatcaaacgggaaagtcccagtgcaatctgtgtcagagaaaatggagaagtatggatcggcactgtgggtgtaggccttttccgctatgatccaaaaacagactcattcgctcaatatcataccgacaaggataataacacgctgatgaatcaatatatcttcgccatgtgtgaatatggtgactggatcgccttggccattcatgacggcgaattaaagaaatacaacccagatacgaatgtcttgcaaacagtaaaagcaccaggtgtacattataccgtattacgcgatgtcgcttgcttcgaccagaaaaaactttgggtctgctctcacgccggcttgttcatcattgacgagagtcatgaaaaagtgactcatctgcaggaagacctgatgcactcgtatagtttatccgacaatattattttctgtatccataaagaccaggaagaaggcatctggcttggaactaaattcggaggtgtcaactatttaccgaatcatcagcttttatttgaaaaatatgttccgtcaagttcggaaagttccctgaacacccgacgtatccgagaaatcgtagaagttccggacggaaagatctggatcggtacggaagataatggtattaatatactggatccggaaaccggagaagttaagcaactgcaatatccggcagccgaacgaaagaaccacctgatgacccattccatgaccacgcacaacaatcagctgtactgtggcctgttcaaacagggctttgacatcatcgacttatccacacaatcgataaagcattacagtcccaaaagcctgaacatcgatgaagaaagcgtttacgctcttttagtcgacagtaaaggccaaacctggctgggaaacggctggggattatacctggcaaagcccggtacgctggatttcaagaaaatcaacgaagtaggcctcgactggatctttcacatcatggaagatagtaagggccggatatggatcgcctccatggggagcgggatatggaaatttactccgaatgaccattcttttaaaaagtacaatcatgaaccgaaagattcaaccagcctgagctcaaactccgtcagttcctccatggaagacagtaaaggacagatatggctctctaccgaccgaggtggtatctgccgatataacgaaaaggaggataacttcaccacattctccaaagaacaaggcttacctgatgatgtagcttataagatactggaagataaaaatcataatttatggtttggaacgaataaaggacttgtaaaattcaaaccagagaccggagatattcgtatatttacaactcaagatggactaatcggaaaccaatttaattacaattcagggctaaaagcaagcgatggaaagttctatttcggaacgattgacggattaatcgccttcaaccctgacgatgacgaacaaaatgactttattcctccgatttatatcactaaattcagcatatataataaagaaataactgttcatacgcccaattcacctctaagtaaaagtatcctgcatactaaccggattgtattaccctacgacctgtcaaacatcagctttgatgtagctataccttcttattcatctactcgcaacaaagaatgcttttacaaaatggagccactggacaacaactggataaaagcgaatagcaatcaaaatatatcctacgccaaactccccccgggggaatttatattccatgtaaaaggaacacaggaagagttagcaaacgcccagtcgacaacttcgctccacatcacgatccttcctccttggtggctatctgtctgggcctacattatctatacgatactgatattgtgcctaatatatggatggtttcgttggtacaaacaacgtaaggaacggcagatggaagaaaagcaaaagcttttcgaaatagccaaagaaaaagagctttatgaagtaaaagtggaattttttacacaaatcgcccacgaaatacgtacccctttaactctgatcaatagtccattggagacaattctggaaatggatattcaggacagcaaaatcaaacgcaacctgaatgtaattgcccaaaacacgaaacgcttgctcgaactggcaagtcaattactggacttccggaaaatcgatgccaataaatttaaaatggacttcatttgggtaaatgtcggaaccttactcaaagatacgatcctacgcttcgaaccgactatggtacagcagaaaaaggaactgtctatcgccatccccgataaagaggtcatagccgccatcgaccaggaggctgttactaaaatattgagtaacctgctaaacaatgcccttaaatattcagctcataaaatcaaggtcgaactacaacaggcggaaaccaccttcagtatccgtatcaccaatgatggaaaccgaataccagccgaactcagtctgcagatatttgaaccattctatcagatcaacaaaaaagaaaaaacatctaccggaaccggtatcggtctaccgttagctcgttcattggctatgctccattcgggcaatctctcattggatacggaagcaatcgacaattcatttatattgactctgcctcttactcaggaaaaagtcagacaacaggagagttccgctcttcaggaagagttcattttctccgaagaggatactaatattcatattgaaggccggaattatacccttttgcttgtagaagataatgataccatgcgttcatttcttgctgaaaaattacaagagttttttattaccgaaactgctccaaacggaaaagtagccttggagatcctgagcgaacatcctgtcgatattgttgttagcgatatcatgatgcctgtcatgaacggtctcgaactatgtaaagaaatgaaagcgaacattgagctctgtcatattccggtcattttcctgacggctaaaaacgatctcgacagtaagatcaacggcctgcgcctgggagccgaagcttacgtagaaaagcctttctcattcaattatctggcaacacagatttcttcattgctgaataaccggcaaaaagaacgtgaggctttttctaaacgcccgttctttccggtcaataatatacaaatgaataaggccgataaagaattcatggatcgtattattgccattatccacgaaaacatcacagatgaaaacttcggtgttgagaaactcgcagaaaaactttccctgagccgttccagcctgttacgcaaaataaaggttttatccggactgtcacccaatgattttatccgtctgatccgcctgaaaaaggccgcagaattaatgctcgacggcaaatacagaataggagaaatctgctatctggtcggcattaactccccttcttattttagtaaaatatttcagaaacagttcggatgtactcctaaagacttcgaaaaacagaatcagccgccgaatccttgattccaaaggatttggcgacctctgtctgagtactattttattaacttcaaacattcaatatcctgaaaagaggaaattgtccggacaaaaaatacgccttttgacagatcggcaatattgacgtcatagctggtttgcggagataaagcaggaaactgtttcagtaacgttccctgcgtcgagtagataagaatctttttcaattctttttccgtctgtataaacaaatgatcgtcctttacccagccgattacttttttatctggtgtagtaagatcggacacccccgttcctccacctttcttatctattctatataacttcacgccacaatcaggtaaagagaaaggtatttcctcccctttcaatgacacatcctgaccggtccacaactctttgatacctttcacatcggaagaagtaattcccaaccgggacagctttatatcctccgataccgactgggcattataattaaatgcagccacatacgtataatcatccgtatccagcataaagagacgttccccccgattccttccccaactattcttacctgaggctttcgcgccctctaccggataaaaagatttaccgatacgggctatatcattcacatcggcattcgtcgcaaacttctctgccttctgacgggcagcgaagtcaccgacacaagtacctttttggctgaaattatcacccagaatatatgtcccggtaataactccggaagtgatgcgcatacggttctcatcttcgctataagcatctttatgaagtaccaagtgatcggcatcattaaagtgataaactctatcgagccaccagccataagaaagcccgttcattacatattcggtatcttctttcgctccccaagcatcgcaactgatacgacgagagttcccgtattgcgccgggaaagcaggagcaatggataaagccataaacatatcatccccacacagctctgtcagatacttcattccgctgttatacgcctgtacaccggtcgtaacattcttatcataataagagtccgcttcaaggatcgcattgttcagaaagtcaaacttgatgtatttatagcccagttccttaaaacggttgatgaaatagctcatccgttcacgggttccgggatgtgtcggatccaaagccctggaagcaatctttttaggctttccgttcacatacaggtaagcctctccgtatctgtatttgctgccttccatcgtgcggctaccattttcaccccaatcagagaaaggtgcccaataaatacctggaacctgcccgttatcgacacattgtttagcaaaggttttcaactggtcgtcagttagattatcccagtatgagtcaaggatcacataggctgtaccgtcattattaaaatgattcggttgcaggttcgtactgatataatcggagacatcgaggacaccggtaaaattcagtttatcagccattgctccccaactattccagccaaagacatttcctttcgcccatttacggggaggagcaaccagcgcattcgcttcgccgtacgtctcaagtcctttgcgccagtcatcaaacattccgaccagaattttcggagatttcagtttcgtaccggaaatactgccgtggggtttcgaaccctcagcatcgatatcatgggtaatacggtggcttatcccgccaaagcattccaagcggttcaccttctggttaccggaagtagaataacgtattcctgttttccaggtgtcatgttctacagaaccaatcaccagcccttcgcgtgtatcacccgaatagatagaagtaacctcgaatgagacagagtctaccgacaaggcaagcgcagaataaccgatccaggcatcattatcgaacgggacggataaaacacggttggaagaattggcgttcaggaaagaactggcagtctcagtaacaaccggagcaatataattacttgacattgtcgtctctgatacaatatacgcttccgtcaggaagtaatttttatccggatagaaataaaacgattgctgcagagaaggcttttcaccctgtgcggcataagtaaacgtatatttatgtccggcaccgaaagcatcatcaaccgtttcttcaaaaaaagtcggtgcggcatattctgaactgcacaatagcagatctttatctttcgcctgaacaaaaacacctgccagtatggtctcttccttatggataaagtcgcatgtctttgttccttcattataaacgatcttccagtcaccggaagtaatcacttgctgttcgcttgcaaaagcctttgtcccaaacagaaggctgacaatacctattaataagtagtttcttattgaaaaaatcttcatgatatcttttttggtcattaactaaaacaccgggcaaagacataccttccccggtgtttttcttctacaatccttttgcctttctatattatctgtaaccaggattctgatcatcggcagtcatatccggattctgttcgatctctacgttgggtatcggataacgaacgttgaaatcttgaatcgttccggaacgtttcgcccatttgttgcgtgccttgatatactcaacaaacttacctgtacggatcagatcggcacgacgccagttttctcccaggaactcacgcatacgttcatccagtattttgatacggaaattatcctgcgacatgcctgtatcccatcgtttatcagccggaatgctaaagttccaggcacggttacgtacttcgtttactttttccacagcctgtgaggtctgtcccaattcattcagacactctgcataacttaacaatacatctgcataacgaagagccggaatattcttaccggagttccacatattattaatacccagacctgaatgctggtcggtacggtagtcttcatatttctttacatgcggcttcagttcgtcatggtcttcgcccaaatcttcccaggcaacacattccaggttcggcacttctccgttatacgtaaagtcgtaacgtatgctttcttccttacgttcgtcgccatcttcccagataccaccgttttctacggtttcatatccatattcagtgacaacaacattgtcgtaaccggcaaagtaacaaccatcagtccaccagttctgtgctacacgcgaaccgatctgaaactggatctggttacggttcggattattgttaaactggaattcatagatagattctgccgtattcggcttctcgtaattccataggtcggcatagttcaccaatgaataacccatccccattactttctcgaaacattctttcgccttgctgaaatcacgcaaaccggtttccgtcggagccgacatataagccttaccaagcatggtataaccagcacccgaagttgcacgtccggcagtattgtttttcggtgcatatttagcagctttttccagatcgttgataataaactgccagacatcggtcaaaggttggcggccatacccggtctcttccagtttgttcaggtcgatgataggtatttcaccccaatacattgccagttcataatctacaaaaccacgaatgaaagcagcttcacccaaaagttctgcttcttttgagccttccgccaaatcaggcacatccaatgcccgaatgatcttagctgcagcagtaactacagggaaacgtttgttccactggtctctcaccttttcatggagcgagttcaggttagcgtcataacggtcgagagccgccccttgtccaccccctttatgctgaagtgcaccacgctgtatctcatcagaacccatcatcagaaaacaggcacgctcatcctgacgggtattatcgcgccaagtattataaatacctttcagattcagttctataaactctacttccgaatagatttgttcttccgtcagtgctttcttgttttcctgtgtcaggaaatcggaacaagacgtggtgatcccgacagtaaatgccaaagccagcaatccgatcaaattatatctctttttcatacttgtaatccttttaaatcattaaaaactaaagttcaaaccaaatacatacatctttgtcggaggatatccgtaatcgcctgtctctggatcgaatcctttgtatttggttgcacagaacaggttggatgcggtaaagtaaacacgcaggttttccactttgatctggctcaacaacggtttcaggaatgaataagccaatgtcagggtagacaaacgcagataggatgcattctgaatcgtataatccatatcagacggattataacggttataaccgctggtcgtattggcaatcacacgcggaacggaagcaccggtattttcgggtgtccagcgatccaacagatctgaagaagccatacttgtacctgtactgttgatcaaaccttcatagtatgaactgatcttctttgctccgtaagaatagttgaatacagcattcaatgtaatgcctttatagtttaaatccgtagcaaatccaccatagaacttcggatcctgtttgcctacaacgacacggtcaagctgatcgattacaccgtcaggaacaccgtcaggaccggatacatcttgcgggaacaggtcacccaggcttacatgcttaccattaaagtcaagattttcccattcactgcggttcgattcgttagcgataccgcctgtcttataagtataaatgttattcaaagattcacccaggaagatattcttttcacgcaggtcatctttcgcattcaggatctcttttacttcgccatacaatttggatacctcgttcttatcaaaagagatattagcattcacattccatgtaaagtcttttgtctgtaccggagttgcattgactgttacttcaaaaccgttattctttacagaaccgatattttcccatgtttcgctataaccggaagtcagcggcaaagagtgcttcattaacaggttatcgttcttgataaagaacccatccaaagaaacattcaaacgatcattcagaaatgccatgtcaagaccgatattggtctgtttctgtttctcccaagtaatagccggtgtacctctcaaaccgctggtagcataagaagcctctccgttactgacagaagagaaatacaatgtccggtaggcatagttttcgatatcctggttaccaaccacaccataaccaacgcggaatttcaaacggtctaaaatagtctggtcttccatgaatgcttcattcgtgatatcccatgcagcagagaaagaaggcaggataccccaacggtgaccttttgcaaatttagaagaaccgtcataacgggctgtagccgtcaaatagtaacgcatgtcatagttgtaattcaccctacctaaaacagacacaagggtatttgccttaaaatcagaatcgagttctttcttatcgttagcagcagcacctttcaggtcattccacagcaaatcgtcactggcaaaacgatcaccttgtgctttggtataattttctgtgtttttggttgtacttgtaccaaacaggaaattcatacggtgtttgttgactgtcttgtcgtatgtgattgtattatcccactgccagttcaactgtgaccatctttcatgttttgctcgtgcatccccattatagtggcggattgcttcctgaatataagaaggtgtatattcgaaccaagtctgtgaagaaacgtccagtgcaaatgttgaacggatattcaatccctcaatcgggttgatattgatgtaattggaagaaaggaaacgattacgggtacgttcacgagctacttcctgtgagttgaacgggttataatcattgttatttccttcattgtgcacacgatagtacagtgtcaaatagtcccatgtataacgagttgaagggtcacggaacggttccgggttcaataatgggtttgcattcaacgctttatcgtacacatcatctgtcggtaaattattttccgtacgagaaaaagaagagtttgttccaatctttaaccacggtttaatcatagtctccgcattaatacgaccggaatattttttttcttttgaatctccgatcaatccgtcgatattagcatagtcgaagctaatataaatattgttcttttctgttgcattagagaaacttacggaatggttctgctggaaaccgttgctgattacttcatccaaccagttatagctcttacctgcgcgataagatgcaaactcatcatcagagaaagccgtattggtattcatcaatgtactgtttatataatcctgacggtttgcagttggattatcatgcatataaccattggcaaaagcatctatacgcaaatcaaacaactgctgtgcatccattgtcttcggacgctgggtaatttttgagaaaccaacccaaccgtcgtaagtaacacgtccctcaccgattttacctttcttagtcgtgataagaacaacaccgttagcaccacgtgatccgtaaagggctgtagcagaagcatctttcaacacctgaacagaagccacatcgttcacgttgatggcgttaaaaccaccgtaaccgttacccataaccaaaccgtcgacaacgtagatcgggtctgaaccggaattgatcgtattcacaccacggatcttgatacttgaatcgtcacccggacgagttcctttggtgatcaaaacaccggctacacgtccctgaagagcttcattgacagttgttaccggtctttcttccaacactttggaatccacatgtgcaatagcacctgtcaggtcgcttttcttcatggaagcaccaacgataactacttcatcgatcgattgtgaatcttccgaaagcgatacgttgataaccgactggttacctactttcacttctttcgtgtcatatcctatataactgatcaccaacgtagcgccgggcgatgcagtcaaagaatatttcccatccatatccgatatagtcccttgcgttgttcccttgagaacaacgctcgctcccgggagcgactccgacgttttagcgtcggtgatcgtacctgtaattgttatgttttgcgcgaaaacggtaccgcaacataatacaagcatcatcaaaatactaaaaagcttgatctgtttcataattgataaatttaagaacatttagttgtatccaatcttataaagcaacgcatccttggcagggatcgtcacctttaatgtttccttaacaggttgttcatctccgctccaaagctctttcacccggtaagtaacggttggttccagaccgagacgttcaagtgaaattgtggtgttcatctcctcttccgaataattaaagatagcgaaataagacgttccgtctgcatcatgatgaataaattgattttcagaacgctctccgtttccttccaccggagtaaacgaaatgcctttagcgacagcatttacctccggattggtcatgaatttcatagcacgatctttatctatttgttttccgcctttactgaaatcatccccaacgatatacaaaccggtaatggcaccggaagtcatacgggcacggttctcaccttcggtcgcttcacgcagcaccagatggtcggcatcattatactgatacacttcatcctgccaccaaccgtaagaaagggcattcagtgtatactcagtatccttgatcttattccatgcatcgcaggcgatacgacgtgaattcgcgtaatgggcagggaatacaggagaaatcgacaaattgatgtacatgtcaccgaaatatttattcaataactgcataccgtagttgtaagcctggatacctgtccggatttccggattataccatttgtcggcttccatggctccatgcgtcataaagtccatcttcacatatttgaaaccgcaacggtggaacaagtcagaagtcttcttcatcatctcctcgatggccggatgagtcgggtcgatcgcataagcgccgtccagttcctgaggctgaccgtttgcatacagatagacatctttatacttataatcaggagcatcctcgatggtccgttccggatgtttaccccaatcggtaaaaggcgtccagtacacaccggcaatctgtccgtttgccgcacaatgatctacgaaatctttcagttcctcatctctaaagctgttccagccggaatcgagaccgatcgtcacattgccgtccgtatttacaaaatgattgttctgcaaattattcttgaagaagtcggatacttccaacgccttctggtaagtcagattaaactgaagtgccccccaactgttccagccgaaagtaacggcacccggccatttctttacaggagccaccaccgcatttgcttttccgtattcttccagtccggcacgccagtcgttaaagaagccgacaaatactttcggggattttacttctttacctttcagtgcaccatgtgctttcgaatcacgtgtcaacgtatcggctacacctccgaagcagaccagcgaaccgatattattacggtcaccctgagtcatatcgataccggttttccagtcggaatgttccaccgaaccgatcacaagacctttacggtcatggttattaaatacggttgccacctcataactgcgtaacttatcgaaagtcagcggatgagactggtaacggatccagcaatcgttatcgaaaggttggaacaacgcacggttatccccttcggcaagcaaagcaggcatacggtcgacgttgaccggagccatataattcgattcgacatcggcatcccctccctgaagagtgaattccgtcaacagataatctttctccggatagatgtagaaagattgtaccagtgtaggcaggttactgtcggtataggtgacctgcaataatgacccctcgccgaaagcgtcgctgatagcggttgctttcgaccggctattcttgtagtcacgggtagtgaccaatctgtcgcccagtttatatgaggcgtagactccatcggaaagaagctgattctctttctcgatacgatggcctttctgcgcctgatcgtagctgaccgtccatttccccgaagaaacggatggttcaccacaggacacaagcagggcgagcaataatagcagatttaaattgatgagtttcatgtattgataattaaatgtgtgttttcaaatgtggtccggctttattccggacaatatcattgctccgtaatcaataggacagtactttcatacgtattcccgatcttcaggctgatgccggcattcatcagataatcgccggggaagacctggccgtctccataaaaggtactgtctccggctttgttcaattcagtaatcttatacattttagccggatccagtcctttcaatttggtctcaaagaatgtcgtacgtccgtggtatttcaggctataagcaaaaaataccgattcctttttatctttcgatatatacatatgcgaagcccatccgtttccgtcgtaaggagatttgagacgatagaggtcgcccagctgtacgatcggacggatacgtttatagttcctgatagcctgttctgcaaaaggcaattcatcgccggtcagatccttcggctgcaactccatacccaaacggcctgtcatggcgacatcgaagcggaactttagcggagccatcatacctgtctgatggttcggagtggtcgacacatgcgaagcagttgcctttgccggaaagaaaagattcgtactgtattggatgaatatacgatcaagcgagttggtattatcgctagcccagaactcatcatgatatttcaaagcaccgaagtcgagacgaccgccaccggaagaacacaactggatcataacatccggatgtttttcacgaatccgctcataagcactgtacagtccttttgtatactcgatccagaagtgggtctgattttctttcgacaaatagtcggaaccgaagttatcgacatgacggtttgcgtcccatttaatataggaaatatggggagatagggcaatcacatcgtcgaaagtctgtaccacaaagtcctgtacagccggattactcaggtcgagcaaccattggttacgcatcgggataatatcccgtttgccgctcttcacgatccattccggatgcttttccgccaattcgctcttcgggcttaccatttccggttcaatccagataccgaatttcagacctttatttacagcgtatttcgccaggtagtcgataccacgcggcagtttcttcttattcacctgccagtcacccaggccgactttatccgagttacgcggatacttattggcaaaccagccatcgtctaatacgaacatctcgacaccgaacccggcagcatcatcgatcatatctgtgatcgtcttctctgtaaaatcaaaataggcaccttcccaactgttcagcacgatcggcaattcctgatcgccatgagccagtgcatagttacgcgaccagtcatgcagatttctggaaacctgtcctttaccggcagagctgtaggtccataccatctccggagtttgcaagactttacccggttccaggttataagtagaggcaaaattattcatgccggtcagtatatgcagcatgccgcattcatctatttcaaaagaattcagatagtttcccgaccaagcaagggaaccgccatagacttcacccatatcttcataagccggtccgttcagagaaagcaggaaagaagagttttcagactgtgtagtccgtacccctttcttagactctatccgtttgacaccggaagtcagttgttcttccaccaactgcatttcggaagcccatgcaccatgaaaatgcgtcagataataggaatctgcatgtaaagggagataagcggaagatacattttcgactgccagacggctattttcctgatgggagatcgaaactgactggcagatcacattctctttctggtaagcaacgaagttcagattgacaaaaaccggatacaaaggatctttcagccggatcactgtttcgactctgttagcatcgacattctttaccgaatgatctgcatatattaattcggtagtctgaacaccgtcagtatgtgtcagcttcagtgccggattcaggaaaagacgacctccgtaagcaggatagattgccggagcataaccgataccattatccggctgttctttatacttcttagtaaggaaaggggaaacatgctggaacttatctccaaaatagttatatactacctttttatccggagagatagaaaagaccatatttaagtcgttcgtagagacggatatgatatccgcatctttctcctgggaagatacattcatacaccccagtaagagggctacagttaacaatagtgctttcatgtctatcagttttattttacttattcaaggttgatggtgcaaactaagccaataaacagaagctggaaaagtacggattcgccaattatttgtatttatgcacttaattcatagaagactaataagattgcaacatttacgtcattttttgacgcatttataacaagggtaaaaaacaaaaaaggtttgcatccataaatgcaaacccctataaaacattaaaggctgtctcacgacaacccctaaccaattttgttaaccttaaatctaatactattatgaaaaaaccacaatgcaaagataagccctgaacaagggtttgtcaagtcttttacagacaatatatgttaagccttacgagctttgtagctaaaaattgtttccgaacacaaatctttatacaatacagacaaaaactgctaattttaacagttaaagcgaggcattttataaagaaagccgctctttaagcaacctgtatccggtcaggctggcacgcaagcagacacctgtcttcagacgtacctggtaactgtctttgccgaacaattccacacggatgatctgatcgctgttcacgatacaggaacggtgaatacgaatgaaagagttttccggcaaatgcgtctcaaaatatttcattgtttgttccttgacatattgacctgtcgaagtgaacagcgtcacataatcgccgcttgcctggatatagagcaactcatccaactggatcagatggatacgtgtgccgtctttcacagagatacgatccagcaaagtttcttcaggtggcaatgacgtttctgtctcaagagaaacagaagaatcctcggacgggtcctctttccgaatctctttccagcgaataaaataccactgagccagaatgatccatactaacagaccaaacagaaaacgaaaagggatcgtggaggcaaaccattccatccgatcggggcaaatcaatgtccccaccatataccctcctatagtagaaatcgccaagacaccgatggtcaatgcgatctgggcctgtatcgggcgcaatactccggtaacataccaaagcagaaaaccggaaacagagaataaccctaccgagaccagactgtccagccaggcaacaagccaccccgtatgttcgtagtaatacaacaacaaggctcctatgccacaagctatcaacgccaacgtgataccggcaatcctataaaagacagagtttataaacggatgcgtctgcataatcaacttttgaattcaattccgccgaaagttgtatttccacgtactactaacacatgttctttatccatatctacagaagcattgaagcgtttatcttcaattcctcccatcagcggacggacattaaaatgaagtcgccagtcattgggcacatatatttccaccccggcaaacgtacagtcgatgtcaatataggttcgcggaccttccagctttgttcgtcgcagatccagaacggttcctccgaacaaaaccttgatccgtgcccctttgaaaaccggttccagaatgatctgctccacggagctaaacgtattatccgattccacataaccgtctatattgacaaattcactttttgtgccagcgtctgccccgttccccgtcgcctcccctctatttctcccataagcattgtttttctttcgtggcgaaaagaggatcacgataccggccaacaccaggagcagcggccaaatagtcataccactgccatccatccaatccagttccggcatcagaaaatagaatccgaataaaaaggtgatcaaccctccgacatactggcgggagaaaaaggaaaaaactccgacatacataaccagcatctgccaggatactataatatcaaagatatcggttgctatcatacccatattcttcaacagccatacaatcccgactacgataaacgggattgcccaaaagatgttttttctaaaagccataatctatattgtttaagtgtttgggacaaaagtaggtatcagacatctcccgaacaagagagatacgctctattacaggcaaatatcggtgaactgccgataattaccgataaaaaaaggatattatttactctttgccgcaaactttctatttataccggcagataacaaacacaaaagggaacagaaagcgaccagtatacaaataagaaaatgcaatatcaactatcatactatcattcttcgacttattcaccatattatcaatatattagattatgatagttgctgttttcaactatcattcaactatcatacatctatcatcatccatttaaaaacagaaaaggctataaccttttttgagcagatatatggctaaaaatcaacaatatagtaataaatatgttttaccacccgggtctcaatgatcccgacacccggatgtgagcatcgtcgagatgggggtgtgaaaaggggtgagaccggcatctcagcaagtaagagtaagcacttccatgaaaatatactatcgctttgatgaaaatatactatcgcttttggagaaaaagcaggagggacacgatgaagcaccccctataaacaattaaagcctgtctcacgacaagccctaaccaactttgttaaccttaaatctaatactattatgaaaaaaccacgatgcaaatatacagcttaatccaaatttgtcaaggggttttatgctaaatcatgtttcgtgtcatataagaaaagctaacaagtttcaatatgtttgttttttgcttccgaagtgttaaaataaacactttttgttcctatttcttctttaatatgcgttgcgcacagtcggataatacaacgatcgctcccgcaataatcgccgtgtctttgatcaccaaacggcctgctcccgtaagcagcgggaaaccgtgttcgccacttcccaagtccggaacccatacctccggcgtagtgacgagaaacgacaaggtaccgattgtcattataatggccaacaaggagcctaccagtccaattttaggagaaaagatacccaggaaggttaagataccgatcgccatgatcataatacccagcccgtgagagaaaccatacgtattgttttctacatgccactgatgtttagcttcgttgaattcaccttctttcagtttatattctttatattccggtgcgcttttagtatagaagaagctcataaacgggctgtttgccacgaaagggacaatcccttctgcttcataattccagaacttcaaaccgccgatccatacgaagatgatcaggatagctatgcggatcaggttaatacccagcttctgtgaagaagctgccaggttcagaaacgtgtcgaataaatcttttagtttagtagtcatgtctttctttgtttatcagtttaacttatgatgcaaaggtccgacatttctaccctatgggaaatggcaattctaccggataatttgacaattattccctaatacgcaacaaagccggttaacagaggcatatttcctcgctaaccggccttattacaacgaattatttttaattgcggatgcccagttctaccagtttctgttcgtccagagcatacttccgttcgatgctttgcaacaagtcttcgctgatattcagcgggcggttcagcttcttcatttcgcggtatcctttatatacctgggtaatcatcttacgtggattgaaaaccagtgaagaagtgatccaacagccatgcgtacaccagcagttggccgtatcgccgtgaccgatagcagcaatctcctgcttcatggcatcactctgcatgatcttactgatattacaatcgtaatccttcacattgccgagcggttcacgaagctcgcaggcacggaaacgaccgtcgtagtcgataaccaacgttgtttcccccgccgtacagtccataccccagggtgtcggatgatcgatattggttgcacgtacattatataatgtacgaataaagcccagatagaagaaacgggcgataggcttcctgaaaccgccggtttcttccgccatccgttcgccatatacattatatataggtgccacctggtcctgcaaagcacgcaaggtaggctcggtaagcactttcactccgtcatcgcgtgtcattccgcgggcagcttcgatgatatggttggaaagatggaatcgacctaacacccaaagcatcagatcctgtacctcttccaggttatattttgtaattacggtggctagattcttcaataccctgccgtcgtcggcaaagttctcttcaatcatcttcaaggttcccatcgctttgtagaagttaccgggaacgccacgttgtatatcgtgcgtatcaccaaagccgtccatagagaggctcaggttaatattcagttccggacaattccggcggatttgttttacccaggcaataatccgttcgggtttcaatccgttggtaggaatgttcacgtcttttatctcgttattcttgtagaacatttcaatgatctcgggtagttcttcacgcagggtaggttccccccccgatacccataagcgattgaattgtccggccgtttccgatatcctctttatttcgtcaaaggtcaggtctttttccttcttatccatgtcctcggcatagaaacacattttacatttggcattacaccgtcctgtgacaaacaggaagatagattctaattttctgtttgtgctcatcgccctgaaagagctctttgttcgtttcgtactcattgctattattgattagatttctctattagtattagctcccatttcttatttagcagatagacaaatatatacattccaattagaactatcggccagacctgaaaacattcgcaaatttcaactattatatagcgcaaaacaatctccatttgtgggattcaatgttctatttttaagattatcgactaacgagtctaaatagtcttatatttgtacgttcaaaatatagtggagataacaacatggaagacaacattcctaaattcgacattcctctggattttattgtcggagacagtattacgggtgaaatattaaatcagtacggtcgctttccctgcaagatcaaagccggcattttcgtgctttgcgtacaaggaaccgtacgggccacggtcaacctgaccgaattcctaatcaagccaaacgacttcataacacttcccccgggatgtttcatccagatacatgaagtatccgatgatgtcaaactttgctttgccggattctcttctacttttgtgagtcatattaactatatcaagacgattacaaactatctgcctgttatcttcgactgtccggtcatgccgttgcccgaacaggtatccgtattataccaggaagctttttctctattgatcaaggcttattctatgcctaagactattgataataaagagattataaggtctgttttcacgatcttcatgcagggagttatcgagttgtacaaaaatcatacgccttacagcaatgctccgatgacacgcaacatggagatatgccgtgagttcgtacagctggctatggaaaactacacgaaagagcatagcgtttcttattatgccaaaaggcttaacattaccttgcaacatttctgctatgtgataaagaaagtcagcggtcggacggcgttggatatcctgagcaatatcattatcatggatgcaaaagcacagctaaaatcgaccgatatgccggttaagaagatcgcatttgccctaggattcgacaacctgtcgttcttcaataaatatttcagacaacacgtgggaatgactcctcaggaatacagggaaagctaaaaaagggatatgccggatgcaaacctctataaacaattaaagcctgtctcacgacaagccctaaccaaactttgttaaccttaaatctaatactattatgaaaaaaccacagtacaaatgtacggatctttccagaagtagcaatagttaaaatgctaattagtgttgtatagcacataagaaaggctaacaagattcaagatatttattattagatttcgaaatgttaaaatgaggcattcgtttgtgaaataacacacctcctgtcccctctccagagggaaaaaattggcattggccactattacaaaacaataaaaaacagggcataaaaaaagaggcgctacataaagcaacgcctctcaagcaatacatatatataatgtatattagtcttgcaacttagcagcaatgaattcgcggttcaaacgagcgatgttgctgacagagatattcttcggacattccatttcgcaagcacgcgtgttggtacagttgccgaagcccagttcgtccatcttggcaaccattgctttcgcacgacgagcagcttctaccttaccctgaggcaacagagccaactggctaacctttgcagaaacgaacagcatagccgaaccgttcttacaagcagcagcacaagcaccgcaaccgatacatgcagcagcatccatagccatttcagcatctgcacgagggatagcgattgaattggcatcaggtacaccacctgtgttcactgatacgaaaccaccagcctggatgattttatcgtaagcataacggtctaccatcaagtcgcggattaccggaaaaccggcagaacgccacggttcgattgtaatagtttcgccatcattgaaacgacgcatataaagctggcaagtagttgcgccagttgcaggtccgtgcggatgtccgtttacatacaaagaacacataccgcagataccttcacgacagtcgtggtcgaatacgatcggctctttaccttcactgaccaaacgttcattcaaaatgtctaacatttccaggaaagaaacactctgattgattttgtctatttggtaagtctcaaattgtcctttatctttcggacttttctgacgccaaactttaagtgttacttttatatctttatccatgattctaatttttgtgattgatgattattacttcttgtagttacgtgtttgaggaacaacgaactgatagttcaaatcttccttcagcataaccgggtctttgtcttcaccctggtattcccaacaagatacgtacatgaacttatcgtcatgacgcagggcttcgccttcctcggtctggtgctctgtacggaagtgtcctccacaagattcggcacgatccaacgcatcgtgtgccatcaatgtaccaatctcaataaagtcagccaaacgcaatgccttatccaactctacgttcagattatcggcttcacccgggatatatacattactccagaactctttcttcaggtctttcaacatctggatcgcttcctgcaaaccttttgcatcacgtgccatacctacgtgttcccacatgatatgacccagtttcttatggatagaatctaccgactctttacccttgatactcatcaatttcttaatgcggtctttgatacccttttcagcttctgcaaactcaggcaggtcggtgctgaaacgcggaacctggatctggtctgacagatagttctggattgtataaggcaatacaaagtagccatcggccaatccctgcatcaacgcagaagcacccagacggttagctccatggtcagagaagttagcttcaccgatagcgaacagacccggaatagaagtcatcaattcatagtcaacccacagaccacccatcgagtagtgcaatgcaggataaatcatcattggagtttcatatggatcgtcgttggtaatttcttcgtacatgtcgaacaagttaccatatttagctttcacaacatccttacccagacggttgatagcgtcggagaaatcgaggaatacggccaaacctgtgttgttcacaccgaagccggcgtcgcaacgttctttagcagcacgtgaagccacgtcacgcggaaccaggttaccgaatgccggataacggcgttccagatagtagtcgcggtctgcttcaggaatatctttacctttcttggttccggcctgcaatgcttttgcatcttccagtttcttcggaacccagatacgaccgtcgttacgcaatgattctgacatcaaagtcaacttagactgatagtcacctttcaccggtacacaagtcgggtggatctgcaccatacaagggttagcgaagtaagcacctttcttgtagcactgccatgcagcagaaccgttggaagccattgcgttggtagacaggaagaatgtatttacataaccacctgttgcaacaactacggcatgagcggagaaacgttcgatcttaccggtgatcaggttacgtgcaatgataccgcgagcacggccatccaccttaacaacgtccagcatttcgtgacgagtgtacatctttactttgttcaaaccgatcatacggctcaaagcagagtaagcacccaataacaactgctgtccggtctgaccgcgggcatagaacgtacgggatacctgagcaccaccgaatgaacggttatccaacagaccaccgtattcgcgagcgaaaggaacaccctgtgccacgcactggtcgataatagaatttgacacttcagccagacgataaacgtttgcttcacgggcacggtagtcaccacctttaattgtatcgtagaacagacggtaaacagagtctccatcattctgataattctttgcagcattgataccaccctgtgcagcgatagagtgtgcacgacggggagaatcctggatacagaaattcaacacattgaatcccatttcagccagagaggcagcagcagaagcaccggccagaccagtaccaactacaattacgtccaggcgacgtttgtttgcgggattcaccagtttctgatgatctttataatttttccacttctcagccaacgggccctgagggattttagaatctatctgagtcataatgatttattttcaattgttacaccttaaattaatgtcctgcacaaacagctacataatcaccgcctacaccattcaggtagaatacgatagtaataatagcaaagatcacgcaaatagcagtggctacgatctttgaaatgcagatccaacggttcatccagattgtgttattccaaccgattgtctggatagcgctccagaatccgtgagtcaggtggaaccacaaagctacgtaccataccaggtaaagaactgtgttcaggatattaccctggaagtagtagttgataaacgctgcaccgtcctgaggagatacggtagtcgttccgtcgcaaagagttactgtgtgattgcccagaagttcggcgaacatcatcttataccagaactggctgaagtgcaacaccaggaacaggacaatgatgatgcccagtaccagcatgttctgagatgcccattccactcctttcggacgagcgttgattgcataacggtcgttaccacgagccttacggttctggagtgtaagaagaactgcatacacaaagtgaatcacaacgcctgctgccaacaccaatgttgctgcaacggcataccaattagctcccaacaatgagcaaatcatgttataggcttctcccgagaaagcagccgccacattcattgacaagtggaacaataagaacaaaacaagaaaaagccctgtaatactcattatcagctttttcccgatagaagaattaagtaaccacataagataataatttaagttatttaattgtttttaaagattcgtttcaaccagcttaattgtcacgcaaaggtatgctaaatacacgtatcacgcaaacgattaaagaaatatttcgccaattcaagccatgcatttcggtcgaaagaaatcccgcattatccgccctgcaataattaacatacatattccgttttgtatcaataaataatctattttcaccgaacaattaatgactctgtatgctacatcataaaatactgtgcctcacactagtcacgctctttgccaccactatttcctcacaggaaaaagatagcgcaacagtcgtgcactccatacatgagttcgaaaggacttatgataaaataacagagaataaagcatttaaaatactgcatataccggtaccgttatttgccatatcagcattgacctacaatcagggaaacaagttccggaccatgcggaacacctacgttccgaacttccggtatcactacgacgatttcctgcaatatgcaccgctggcggccgtaataggcatgaagctgggaggtgtggaaagccgcagttcgtgggaacggatgctggtatcggatgctttctcagcctccttgatggcactcatggtaaacagcatgaaatattccatcgaccgcacacgccccgacggctcgtcgaacaattctttcccttccgggcacacggccacggcatttatggctgccaccatcatgcacagggaatacggacttacccgcagccctttatacagtatcggcggatataccatagccaccgccaccgccttcagccgacaattgaacaaccgtcattggctgagcgatgtattggccggggcaggaatcgggatattatctactgaactggggtatttcctggccgatctcattttcaaagacaaagggttaaacctgcctgacaggataagagagtctgcccccaaaggcggctgcccttcctttctcgagtttggcgtaggatatagcattataaacggaagtatcgagattggaaaacagatccgcctcacttcaccgggagcaactcatgtcagtgtgaaaggtggctatttcttcaatccctatatcggcattggtgctgaagttacggcccttaccagtccgatggcttttgacatgtcgttatacaacggatcttccccttcggagagttataatatcatacgggttcatgccgatccgacaggcgtatttacttttaccggcggtccctatttctctttgcctgtggcaggaaagttactactgggaactaagttccaggctggctactcccactttttgggaaatgaagttgaaatcgatatacaggataaaatgccccctaatataatcaaaaaagatatcatctttatgaaaggggaaagtagtaacggcctcatcatgcgtaccggcatttccgcaacaggtattatcaaccggaatctgggcatccgcatgtatgtggattacgattatacttcgctgaatgctccttaccggatattgtctaatccaggagaagaaaaacctgtatatggcgatctccattacagcaaacataagatgcattactttacgatcggtgctgctgtaaccgctttattctggtaaaagcgactgttcacacagagccaacaaattgtatacatgcaacaatatttatcaataaacacgtgaaatactaataaatacgaaacatataaagtttttacgacaacttcgtaatgttatttacgaacatttcgtatgtttgcttcataaacataaaagcaaataccatgaaaacaaatgtatttatcagaagcatcctatgcttactcacggcatgcctgtttcaactagtaagtgcacagttgcccgttgccgaatatcagccggggatagcaatcctgacaggtcagatcaagaacttcaatcctgagcagaacctggatatccgttgctcagcccccaacctgataatgatgcgaaccgatcctatatttatacaaccggacagcactggacatttccgtcaaaacgtcgcactgaaatatacaacacaggttagagtcaaaataggaaaagattacctgtacctgctgatgtcgcccgataacaaggaataccatttgtcgatcgaagcgaatgaacaaggagcccagatgcccattcgcatttccgggccatacgcagaaatcaacaacagtttcaactttaagctgaaacgactgtctataaacatgttcgtccccacaacctgcgaactcaccccagaccagtataaagagacatgcctgcaagacctactgaaaataaatacggaaaacaacagtctgccggccatcagtacggaagcaaaaaaactaatggagttaaccaatgctttcgaatgccttgagaatctgaaccgctgcaaatacgcaatgatctattcccgcatacaaaaagacaatctgcaacgtatggtagcgttcggactttacaaagatttccggttacccgacaactatttcgactacctgaaagaaatgcctttgaatgatccggaagcactactatgctacaacttcagcaatgcaattccttttcccggcgattatcaaacatatcaggacgaagatgaatattacaagtacatattggcatatgctccaatgacccaggaagaaagagatatgataaacgactacattaaaaacaggtataaatctgataactatcctcacggcaatgaagtaatggctatcagtatgaaatacgaaaatatctaccaaaagaaacaagatactgatctgttggaattgaaaaaaagactatcctcattgaccggccaagaacattctatgattacagaattggcagacatccgttttgcctattttcaatttaggaatttcaaaccgttgacagcacagctggaagcttattacggacaatctctcaccaacccactctgtatcaatttgctgaacgacaccaacgaaagcatgaaacccaaaaagaaaatacagcctaaagcaggtttcattctacgcgacaatccggactgcacagccgatcaggtactggatgccatcatcgaaaagaataaagggaaaatacagcttatcgacatgtgggctacctggtgcgtcggttgccggcagacaattaaagaatacgaacctttaaagaaagacttccccgatgtcgccttcgtatacctgacaaacgaaacatccccattggatttgtggaaaaaactgatccccgatattgcaggcgaacattaccgcctgggcgccaaacaatgggactatctatggacccgcttcaaactgcaaggtgtcccctactacctcatcatcgatgaaaaaggagagattaaagatcaattcatttacaccaacaagaaagaagtacagaagaaattaagtgaattagttagccggtgagtcggaagaattgaacttttttagctatgtttgcaaatgcataattaaaaaaggcaatgaagacactggtacacactgagaaagaacatatagaagagatcatccgtagctgcgacgtctgtttcgtcggtctggcagatacggatggtacaccttacgttattcctatgaactttggctatcgcgatggtgttatttatttacattctgcccaggaaggtcgcagcatttctattttggagcgtaatccgaagatctgtatcacgttcagtaccgatcacgacttggtattccagcatcccgaagtagcttgcagctatcgtatgcgttcgaaaagcgtcatagcttggggagaagtacggtatgaagaagatttcgataagaaagtggaagccctggatattattatgaaacaatattcagacaaagaattccgttattcagacccggcagttaaaaacgtaaagatatggctggtagacctcgatgaagtaacatgcaaagagttcggggcaccacacaataaatactaaacatttaatagaatgagtatatgaagaatttgttagcgatatttttaatggcaatcctgttcgtttcatgcgaagggccacaaggtcctccgggagaaaatgccgaaccgacttactggatcatagaaaatgatatagaagtcaaatcaagtgactggcaactcagcaaaaatgaagccggagaaccaatctatacatacgattttaggatcaaagacaaagattataacctttatatgaaagcttacgaaaacggcttggttaccagctatatgtatctggatcacaaagacgataaactggaagcacaaacaccgcttcccaatcctgtaaaccggcaagacaaagacggcaaccaatggacagaaacctactcatacgattacactattgacggatttatcatcttcaaagtgtcgatctctgatttctatctcgatcaaaagccgccgacgacatatttcagagtagctttaacctattaaaagtacacatatatcagatatttaatgtacttttgcccaaaataagattttcaaaataatgggattgcaaaagcatagcaaggtactgaatgaaacagtagagaagctttcggacgagagctcatacaaacaactgttccatgcataccgtgacgaagaggcattaccttcgggagaagtactgaaggacatcatagacctgtgccgcgcaatcctgttcccgggctactacgggaatgcgcggatcaataaacaaacgatccgcttccataccggagtgaacgtagaaaccctgcataccttgctctgccggcagatctatgccggactttgcctggctgataccagctgtacttcctgcccggaagaaaaaatacaagcccgtgcggaagcactaaccgaagcattcatcgcaacccttccggagatgcgaagcctgctcgctaccgatgccgaagccgcctacaacggcgaccccgccgcacagaacatcagtgaagtgatattctgctaccccgggttccgggccatctgcaactaccgtatcgcacaccagctctataagctccgtgtccctttcatcccccgtatgatcaccgaaatggctcattccgaaacaggaatcgacattcatccgggagctgagatcggacactatttctctatcgaccacggaacaggaaccgtgataggcgaaaccagtatcatcgggaaccgtgtacgtatcttccagggcgtcagccttgccggagagaaattgccccccgacgaaaacgggaatgccatccgcggcgtagcccgtcacccgatcctggaagacgacgtaacagtctattccaatgctactctgctgggcaggatacggatcggcaaaggagcgacggtctgtggtaacgtctggatcaccggcgatgttcctcccggcgacgtgattacgcaaaataaaataactaaataaatatcttttcttacaacgcacacaaatgagtaacgaaacatttgacatggtggccaaaaccctatacgggttagaagaaatactggccggtgagttattagctattggcgctaacgatatcgaaatcggacgccggatggtatctttcacaggagacaaagaagtgctttacaaagcaaacttctactgccgcaccgcactgcgcatcctgaaaccgatttatcgctttaaagccaaagacgccgatacggtttacaaggaagtaaagaaagtagtatgggaaaactacatgtcactggacaagaccttcgcgatcgactccgtgatctattccgacgatttcaaccattcaaagttcgttgcctaccgcacgaaagacgcgatcgtcgactattttatggagaagcacaacaagcggccttccgtacgtgtgaataatccggacttatatatcaacatacatatctcgcacaacgactgtacactgtcgatcgacagttcgggcgagagtctgcacaaacgcagctaccgtgtcgagcagacagaagctccgttgaacgaagtactggccgccggcatgattctgaagaccggctggaaaggcgagacgaacttcgtcgacccgatgtgcggctccggtacgttgctgatcgaagcagccatgatcgccctcaacattgctccgggtatccatcgcaaagaattcgccttcgagaaatggatcgatttcgaccaggaactgttcgaccgcatctacaacgacgaaagccgggaacgcgagttcaccttcaaatgctatggctcggatatcaacccgacagctatcgaaattgcccagaagaatatccgcagtgccggactggttaaatacatcgacctgcaaacactgcccttccagcagtatgcagacgcaccgcaaccgggtatcatggtaaccaaccctccttacggcgaacgtatatccagccgcgacctgctcggactttatacgatgatcggcgaacgcatcaaacatgtattcaccggttataaagtatggatactgagctacaaagacgaatgtttcgacaagatcggcctgcgtccgagcgagaagatgaaactgatcaacggttcgctcgactgcgaataccgttgctacgatatctttgaaggaaagaacaaagattataagaaagcattgaacgaagaaggaggggaagcatcttccgccccacgtcctaagacggagttccccagaaaagaatatggaagccggaacaacgaccgtcctgccggccgccctaatttcaaatccgaccgtatggatagtccagcccgccgttttgccgccgcccatagcgaagatgaaagcgaacgcgcttcggcagctcccggcaagcgtttcttcggcgaagaacggggagacggacgcccggcccgcaaacaattcggtagcgaacgtccggttcgtcccattttgctgaaagccggcgagaaacgtccggtcaagatgcgttacaaagacgaagacgataagttctcgaagaacagaaaggattttggagacagaaaacgtagaagtggagaaggacgctcattcaagaaaccattcaaaagaggcactgatgattttaaagacaaattcgacgattaaacatctgctgctcctttgtatgttcgctttatctacacctatgacattgatggcgcaagacaaacagtttactttacacgacctgatccccggagggaaaacgcacagccgcttcgttccggaaaaccggtcgcagttgcaatgggtcggcgacgacatgtatatatatgtagaaaagaacagcgtaataggagccaaaccgaaacattacccggagatacgtgtcagcctctccgggctgaatgaggcgttacaggctgccggactagatactgtgggacgtatgccgtctttctcggtaccttacaaagacaaacagatactggcgttcacctccaagcagcaccgtatccattacgatatgcagcaacataaggtggtagccgactacaagctggaccgaaaatggagcaattacgagttctgcccggtcaacaactacctggctttcacggaaggcaacaacatacagatccttttgccggagaaccgaccggagattgttacacgtgaaacaaaagacggtatcgtgtgcggacaggccgttcaccagcgggaattcggcatcaacaaaggcctgttctggtcgccggaaggtgacgccctggctttctaccgcatggacgagagcatggtgaccgactatccgatcgtcaatatcgatgcccgctgtgcaaaggtcgaacccgttaagtacccgatggcaggaatgaaaagccatgaagtgacggtaggcgtctacaacctggcaagcggcaacacagtctggctgaaaaccggtacccccaaagaaaaatacctgacgaacatcgcctggagccctgacgggaaaagcatctatatcgcggaattgagccgtgaccagaacgaaatgcacctggtacgctactctgccctgacaggcgaaaaggaggccgacctgttcaccgaaacaaacgaacgttatgtcgagccgcttcatcccgtactcttcctgcccaacgacccggataagttcatctggcaaagccaacgcgacggatacaaccatctttacctgtacgatacgaccggcaagctattgaaacagctcaccaaaggcgaatgggttgtcacgggcgtaaacggctttgatgccaaaggcgaaaaccttttcctcacttccacccaaccgcacatgctgagttcgttcagctacgggacaccgatgaacgtgaacggctggaggctaaacctgaagaaaggcgacacacagctcctcacctggagcgccggcctgaaaagcgtgcataccctgtccgtgagtccttccgggaaatatgcgatagatagctacgaagcccctaagataccgcgtaatatcgacattgtacaaacgaaggacggaaaggtactcgaaaacctcctgaccgctaaaaacccgtacgaaggctatgcgatgcctgagatagaagccggcatactaaaggctgccgatggcacgaccgacctgcattaccgcctggtaaaacctgtcggactggatgaaaacaagaaatacccgaccatcgtctacgtctacggcggccctcactcgcaactggttacaggcggatggctgaacggcgtaagaggctgggatatctatatggcacagcgcggatatgtagtctacaccatcgacaaccggggaacttcgaaccggggatttgctttcgaaagcgtaatccaccgcaacttgggagtgaacgagatggccgaccaaatgaagggtgtggagtacctcaaatcgttgccctacgtggatgccgaccgcatcggtgtacacggatggagttacggaggcttcatgacgaccaacctgatcctgacgtatcccgatgtattcaaagtcggtgtagccggtggcccggtgatcgactggagcaattacgagatcatgtacggcgaacggtatatggatcgtccgcaggataatcccgaaggatataagaatgccaacatgaagctgaaagcaggcaacctgaaaggccacctgctccagatacacggcgacatcgacccggtagtggtatggcaacacagcctcggcttcctgaaagcctgcgtggatgcaaatacctaccctgattatttcgtatatccccgtcaccagcataatgtgatcggcaaagaccgtccgcatctgtatgagaagattacacgatactttgatgattatttaaaataaattacgacgatatgaacattctgttattaggctccggcggccgcgaacacgcaatagcctggaagattgcccaaagcccgaaagtagacaaattattcattgcccccggcaacgcaggtactgcgcaggtgggaaccaatgtacatatcaaggcagacgatttccaggccatcaaggattttgttctggcaaacaacgtgggcatggtagttgtcggcccggaagacccgttggtaaaaggtgtctacgacttcttcaagaacgacgcttccctgaccgatatcccggtgatcggtccctctaaagccggtgcacagctggaaggcagcaaagactttgccaaggctttcatgatgcgtcacaacataccgacagcccgttacaagagtatcactgccgaaaacctggaagaaggctatgccttcctcgaatcgctggcagctccttacgtattgaaagccgacggactggcggccggtaaaggtgtattgatcctcgaaacactggaagaagcgaaaaaggaactgggcgacatgctgaacggtatgttcggcgatgccagcaagacagtcgttatcgaagagttcctgacaggtatcgaatgctccgtattcgtcatgaccgacggcacaaactacaaagtacttccggtagccaaagattataaacgtatcggtgaaggcaacacaggcctcaacaccggcggtatgggtgccgtttcccctgttcctttcgccgacgaagcctatatggcaaaggtggacgaacagatcatccgtccgaccatcgaaggactgaaagcggaagggatcgactacaaaggtttcatcttcctcggcctgattaacgagaacgacccgaaggtgatcgaatacaactgccgtatgggtgacccggagacggaagtagttatgctccgtatccaaagcgacctggtagacctgctggaaggcgtagccgagggtaatctcgacaagcgcacactgacgatagatccgcgtgccgccgttaccgttatgttggtgagcggcggttatcccgaagcctatgaaaaaggcaaattgatctacggcctggacgatgttccatccgacaacatccttttccacgccggcaccgttgccgcgagcggccgtatcatgaccaacgggggacgcgtcatcgccgtcagctcttacggagccgacaaggaagaggccctggcccgctcttttgccggtgcaaagaaaatactcttcgacaagaagtatttcagaagcgatatagggttcgatttgtaaacaaagatgcaaggatcctacagttacacacgcaggcacagtttatccggcacaggtacattcgttgccgtgttactggcctgtgtcgtatgctgggtaatcagctacatgaattcggtgggatatccggtatatggcgaggtgactgcccctccgttgtggaacgccatctgccaggtactgcccggcaaggctttcacctacggcatcggtatattattgatgttcggaggtgctttcctgatccaccgggccaactatatactggtcctgatccgggaaaagacgctgttgccttttctcttttatgtactgttcatcagcaccaatccggacttcctcccactgaaatcgacttcgctgggtgtattttgcctcatactggctatctaccagctattcatgtcctatcacgacccggaagccaaaagcaacgcctacaacgcggcactgctcatcggtgtaggtagcctgttatggattcatatcctgtggttcctgccgctgttctggatggggatgtataacttcaggacattgaacctgcggaccttccttgcctccctattaggggtcggcacgatctactggttcctgttgggctggtgtgtctggttccgcgacttcacgccgttcacgatcccgtttgcctccctgcttaagatacgtttcctggtttcacaggagatcgggctattggactggatcggtatactctgggtagccttcctgacaaccgcttccgccatcaacattattacacatgagttcgaggatgtcttgcgtacacgccaattcttatccttcctgatcgccatgtcggtatgggcattcgctctttatttcctttatgagcaggcctccgaagagttcctggaaacagcttgtgtgcctgcctcgatactgatagcccatttcttcaccgttatgcggggtaagatcatcttctggatgttctattcgacaattgtactttttatttccctcatgatattacgtctatggaatttcttatagaatatggatacatcggggtgtttatcgcctcattcctggcagctaccatcttgcccttcagtagtgaggtagtactgacaggtgtgctgctggccggctcctcctactggccctgcatgatcgccgccaccctgggtaatttcctgggcggtatgagttgctactggctcggtatgctcggcaaagtggaatggatcgaaaaatacctcaaactggatgccaagaagctgcaaaaggtacaggattggatcgcggggaaaggctcctggatgggcttcttcgtcttcctgcccggcattggcgactttatcgcagtggcgctgggtttcctccgcgccaacatctggatcgtcgccatctccatgttcctgggcaaagccatccgctattgggtgtggatggagttcgtttataaggtgcaggggtggctataagctgccggtatttatgggatgcggatgattacaccggtaaagacattcccacggcggacgtagatgggataatctttccggtaatacgtatagttgcaggtaaccgttaattttccaccgtcgatctgcacatcgaacatatcgtcagtctgatagtcgaattacctaaccaggttcgtccgttatcttcatttagcatattcaatgtagtaatattctgcaagtctacagaatcatcgtcgtcggaacaggaagctactaaaaacacattcgcaatgagcaaaagttggaataacagattctttttcatcttttattaaattctagttttacaataggtaaaagttctcaaagatatttatattatcaatgaccgaaagcttttctcctctaaaaaataataatatatcccggccatttcatctccccgcacttctccattgcgaagccggcataccgacatgcttgataaaagcacggctgaaagtcttcaccgagctatatcctgtcgcacctgcaatcttccccagcggccaatccgtatgatccagcaggtctgcgacaaccagccaacggtatttctcgatccatttgtcggcgggcagtccggtcagaaccttaatacaacccgacagttccgtggttgtcagattcagcttcttcgcataaaatcccggatgatggatcatgtaatggtgaaccatctcgacaaaaaggtcgaaaaactcgcttcccgtctgtttattatagacgatccccgtttgcatgccgtgccaaagctcttcctccgttgcttcacgcccgaggaaagagatgaagatatctttcggagtatatttacggtattctattttcatgatagtatctttttgaggagattattctattttacacacacaaattcgttcccacaatatccagaagacgaatttatacattattattcacccttggattaatcagaggactaattacagagatattattcacccttctaaaaatgcaagaacgaattatagatcacaaattcgcccttacactattgcggaaacgaatttacttactcagccaaccacttattcagctgtgtcaatatctgctccttgatatcctccggcatattgccgatgcgggcacggtggctgccgcgaggctggaagtagacctgctcgttcactttgcctttaaactgagggacatgggcggcactccaggggtcgatctcgccatagatgaagatcatcttcgggtcgttatccttcagaaagttatatatcttatgatagagggcaggacggaattccaccttgtcgaccaactctttgggtagcataatgcggttgaggtaacctttgctgctgtcgatggtcaggtatttcttgaaaggcttcgtgtcgtaaccgtagtaacccagttcgcgggcagcctgtacgaagaaagagatgttgggctggttctcggcaaaatagtcgggactgctgatctccatcagatgcttgaacaaagccggactgtcggaatgcaaagaagggatgacggatacaggagtgccccactgccagagggcaaagggatattccagtacgcaataatcgagcacttcggccatcgggatacggtattccagattcttatctttggagaaagcttcgagcaagggaagcatttcggctttacgcttcaagacttcacgctggaagccttctatcttccggcgttcctgccgggtaccaaccttgcggaggaaaggctcgtggcggccgtcttcaacgcctttacacaacggaccgacgtaagggacagagatatccacgtcatcgggaaaaaatgcacggtaaagcatagtggtctggccacctttactgatacctgtgctgatccatttgccggtatacaactgtttgaacgtctggttgacgttgtgcaggtcgtaggccgagttttcggcggtcaggtaatcccagttacaaggctcgggggtcgactcgaggaagtaacggtattctacaaaaataaggttggcatcgagcaaccgggtcaactcttcctgatatttgggattgagagcgtaagcaccaccgtagccctcggtcactataacggtgggccggtcgaaaccgacatgccccacaacgacacgctgggtgaaggttccggcggaaggatctttcgggtctacttgttgggtgatgcgcaccaggtacttttccggatagacatccgattcgagttgttcgataccgctgatccctttaagggcagcgagtttctctttcagttcgcccggagcggcaaaggcaaccagggtgcaaagaaaagagaatagcaagaggttgaatgtttttctcatggtttatcttttttgttatcgatatccttcttcttgctgatcgtacggatcagcccttcatatttcgcccgtttgacggccgacccggcaaagatacgattataatcttcacgggaaaagttctgcagattctctttttgaagggaaagaaagtcgggcgtaggacggaaagcctcttcacgcgtgggccgggcgaaacggttccagggacagacctcctgacaagtatcacaaccgtagaggcgatcgcccagacgggcagcgtactgcgaagggatatcgcctttattttcgatggtgaggtaggagatgcatttgtttgcgttcagacggcaagcactttcgagagcacccgtcggacaagcatccaggcaacgatggcaagcgccgcaacggttcttcaggggactgtcgtaatcgagttccaacgtggtgacgatctcaccgaggaagaagaaagagcctttaccggggatgataaggttggtgttctttccgatccagccgaggccggctttccaggcccagtaacgttcaagaaggggggcggagtcggtgaaggcacgggcttccggggcgggcgcctgggagaaggcagggagaagctcttccgtgatatattgccagagttggcggagcttgtcctttactacaatatggtagtcttttccgtaggcgtaataggaaatgcggggagcatcgggggattgtttctgtgccggataatagttgagggcgacggagataacggagcgggcaccttccaccaggccggtggggtcgagacggatatcccggtagttctccatatatttcattccggcatggtatccttcggctatccaccggtcaaaaaacaaagcttcggtgtctgcggaagaaacctctgctattccgcaggcatcgaagcctaattcttttgctttctcctttatactgatagatagattcattcgaacaccttgaacgtatacccttccttctgtagccattcgatggcgcggggcatggcttcacgcatgttgcgctcggctttgagggagtcgtggaaaacgatgactgagccgttgcgggcatagttcttcaccacgttgaatacacctttgggagtcatgtggggactataatcgcgggtcaccacatcccacatgatgatcttgtacttcttcctgagggccactacctgcgggaaacgcatatgtccgtgcggcggacggtataggtcgctgtggatatatccggcagcttgctcgatatcatccaggtagttcttcgtccaatattgaagcccctgaatatggtggaaggtatgattgcctacccggtgtccgcggtcgagcaccatccggtaaacttcagggtgtttgcggacattatctcctacacagaagaaggtcgctttcacgccatatttgtcgagtatatccaagacccaaggggtaacctcgggaataggaccgtcgtcgaaggtgagatatacacacttctccttggccggtatccgccagattacccctgggaacaggaccctgtaaaaccagggcggttgttctataaacatactttattattctctgcgaaccgaaccgtaagccatccggtagttgtcaaactcttcctgatacttcttagcaaattcgggattataatgtttgctgactgccaatacctgctgcatgacggccaggttatgttccaattctcttgtcacagaggccagctgagacggtttcagacggaagaaccagtcgatattgcgcatggcattctcggcaattccggtaaatacctcttcagccttttcatcctggtcgagggcataataaagctcacccgtagaaagtgcggtgtaatccaacggcacgttttccggaggcaatacttccatacacttgttcagtacgttcaatgctttctcgttcttaccttctttcaccaggtcttcggccagcttattgaacagagccatacggtaactcttacacatacgcatcacgttctcgtcgatataaacacccggtttgtctacgccaccccatttgaacttgttcatgacgttatcatacatcttctccgtgttggttcctttgtttgcattcttcggcacgatctggtaagctagacctgtctgttcaaagtatccgtccaggccgacgaactggtcggggttcacagtgattgcataataaataggacgttcccagtcgtttgtctgcaacatatccaggatcatcagttcctgtttgcccagtgcgttcttacctttcaggtcaatcgtcatttccttcaataagccggtagagtctgttgccagacctttggctacggctgtagcggagtcaaccttatatataagcgtttcagatgggatatagtcgagttcctggctgatgcccggtatcttcttgaacttcggatcattgctacggacgaaattcagggccgtagacaaatcgatcggtttgtcggtcatcgggaatacataagctgcatcgcgtgtaccctgtacataatccgcacgatcccatgagatgggcagtggagccgactcataagcctgtttcttcatctggtcgatgtaccagtcggtttgcaagtagctggtgttacatacacggacatctgtacggataccttccacctcctgggcataccacagagggaatgtatcgttatcgccattggtgaagattacagcattcggttcgcacgactccaggtagttagcaccgaaatcacggcagacgtaacgtcccgaacgatcatggtcgtcccagttctggctggccatctggatcggcacgaacagacaaagtacagttgccacagaaccggccactaccggcgacatcttgccataccgttgtatcagcttggccagtgccgcgacaccgaatccgatccagatacagaacgcatagaaggaaccagcataggcatagtctcgttcacgcggctggtaaggagtctggttcagataaagcacgatggcgatacccgtcataaagaagaggaagaaggtgatccagaagctctggataccacgctgtccggaataagcctgatacaacaacccgaggataccgagtagaagcggcagcatataatagacattgtgtcccttattatcagcgatatcagaaggcatattatcctgcggaccgacaagcacttcgtcgatcgccttgataccggtgatccagttaccgttcaagacctcgccattcccctggatatcattctgacgtccggagaagttccacatgaagtagcgccaatacataaagttgagctgataagcgaagaagtaacgcaggttttcggcaaacgtcggtttcatcacggttacgttttcaccgcaacggttaaacttcaccggttctcccttgaactgcgaccattccttataagctcccacatgggcatcaacgctgctgtacatacgtgggaaaagcatactcaactcgtccacatactcataatcgacatcatgacgtgagatataatatttatctttctcgttcttgtctttcttgatcacgcgactccatacggcttcaccttccttggttacaggagagcagttaccaccctggttttcacgtttcacttccgaagcaaaagtctgtccgtacaacaacggagtcttaccgtactgttcacgggccaggtacgaacgcagggtgaatatatcactcggtgcattctggttcataggagtatcggccgtagcacggatcatggtcagtgcataggaagaataacctactacgatcaccatcaggcataccagaaccgtattcagcaatttgatatttacctttttgctcatgaacaggtaagctgtcagcgcagccgtcaggataacagccagtacataaccgcttccgatgaacggaacacctaccaatacgatagccgcgataaaggcgatcttcattcgcacgggatgaacctcgtcgcgcatcgtttcccagatagaccagatcaatacgcctgccagtacaatcacataggcaaacacacccgagttgtaaggcatccccaatacgttgacaaacaatagttcgaaataaccgcatacctcaaccagtccctgaacgacaccatacatcatcaaagctacgatggcaaaagaaaccaacagtgcatagatggtacctttcatcgtcgggttcgggaatttcttatagtagtaaaccaatacgatggccgggatacaaagcaggttcaacaggtgaacaccgatacttaatcccataagatatgcgatcagtacgatccaacgatcggcatgaggacggtcggcggcctcttcccatttcaggatcagccagaatacaagggctgtgaacagggatgaataggcatatacttcaccttctaccgcactgaaccagaatgtatcgctaaaggtataagccaatgcgcctaccagaccgctacccataatagtgatcatagtacccagagaaatttcattctcatcgttcaccatgatcttgcgggccaggtgggttatactccagaacaggaacagaatagtcagtccgctgaacagcgccgacatggaatttaccattttagccaccgtagcagtgtcggatgcaagctgtgtaaacagattggccgtcaacataaagaacggtgcaccgggcgggtgccctacttccagtttaaaagccgaagaaatgaactcaccgcaatcccagaaactggcagtgggttcgatagtcatcaaataaacggtggaggcgatcaggaatacgatccatcccagcacgttgttgattagtttatactttctcatacgtttgtataaagtgtgataattaattgtctaaaaaagctatcctaacgcagacagtcggccgcaaaggtaagcatttacgtttaataccaacgccctaacactctataaattgtattgaagagattagaattatattaaaaaaccgctgatatttagctgacaaaacctgtccgctttatgacattgtatgacaccaaatgtcatacggatcatacatcttaattatcaggttttatacaaaaaaagccctactttatcgatccggttagttccggtagattattaaaaaaataacttcccggatttattcaaaatccgggaagttatttttacgctttatctatttctatagaaacagttacttgatcttctttaccttattcagtgtcttataaacagaataagcccagaaattacgaagtccgaatcctctggctctctctgtaaattgcttattcaagacaatatccttggttgcgatatcaaatacaacaacattataagttgcctggcctttccctttattaagtagtccggcgatgaatacggcgccatatccctgggcacttccggcattaaaatggcggatatgttctgtaatttcttcatcagtcaattcataaccagcatccggggcaacaaaaccggctttctttatctgttcgataagatcctggacagttgtcaggtctaatgttacttttgcatcgaaagccttatcgagatcatactttttcggttcacgctgaaaaagagtattgattccataaaacgcatctttaaactgttctgtcgtttcatcggcaccatacaccttggccatagaaaaatccacaccgaaaaaagtcagtttttctatgtctttcaaatttgttttatcctgtgcattcacaaggcttgccagaaataaaaacatcaataccatcaactgtttcatacgattacattttaaattagtactaaattatcgcaaatctataaatttaattgctttcctgctcatctgcggcatctgaattttagccacataatcaggagaggcaaactgaatggtaggtgccacccgtactttcgaccggaacagatccttgatttgcttggcgaaagcctccgtttgcagatcgcttcctacccggatcaggatatcgtcagtccccagatcatttgtatagacttccactacataattttttactccgggaatattgtcgagtatatcatataaagccggtggataaagagtggttcctttatattttatcatttgtcccttacgccctaataccgaactaagccgcatcgtattcctcccgcaggaacatggctccgtataatgataacagatatcgcccgttttaaaacggagcagaggcattccccgtacacccagtgtggtgatcgtcacttcacccgcttctccttctgcaacaggctggttcttatcatccagaaactcaacaatgatcaactccggctgcaaatgacctccccggcatgcctcgcattctgtaaaagaggattgcatctccgtggatgcatacgtggattgcaataagggggtctgccatttttcatgtatacgttgtcccaatgtattcagggagaaatcaggattacgtaaagcctctccgatacaaatagctttccttatggaagaattgttataatcgatcccattagcctccgcatattcgatcagttttatcaggaaagagggaacaaccatacagaaagaaggatgtatccgatggattgtgtcccactgtaattcaggtatcccgttaccgacgcgaacgactcccgcccccagttcacgggctcccatataataggccaggcctgccataaaacgccggtcgagcgtggtcatcaactgcatgacatcctcccgcgtgcaccccgccgttgtaaacgaaagatattcgttataagataaacggtccaggtcgcctgaagtcaatacaaatgtaaccggatcacctaatgtccccgaagttgtcacataatcgataatctcagctttatccacacaaacaaaatcttcattatgcagttgcaggtctgtttttgtcgtaacaggcaattgctgtaaatcttccaatgtgcggatacaggatatatcgatcctctcctcgcggaacatacgttgataaaaggccgaacgcctgttcaggtattccagttcatcggcaagccgaagttcctgataccttttgatctccgcaggagttttgaattgtatgtcgctaaacttctccatttcgtttattttttaattcttttttccagtacaatacgttcttcttcttttggtatttctttcgtcaaagcggtctgccaacaggatgcagccttatcctccagaccgaacagatgataataatcccctgccaactgccaggtataatagaattccgggttggataatatgaactgatcgaccgttccttcatcgagagggataccgttaccgatactgtggcgaatctccttcgccaacttcttataggtcaataattgctgataaaccggactattcaaaaaggtatccgcaggcaaagaaaggctatcgatgcataattcttccgtatcaaacggatgggcaaaaatcgcattcagatcataagccacatactcacccaattgccaaggagcagtcgacacccacatcagtcgtttagccggttcaaagatcaccgaatgatgggctataaactggttgagtgctttctcgttggttaatccgatattccggtcttcctttccgaaccggttacgtaatatagatgcagctttcgaagcatctaccgggatattttcatccaacaattcatccaatcgggcataccggtaaggactatcggaagtggctatattctccttattccggacatcatctttaaatgtgtccgactgataatggttcgtacagataatacgatttgtttccgaacgaaacagggcgatctgatcggtcgatttctcaatgatggcagccttcccgtcttttgccgaaccaatcaataaagactcggcaacaaaagttctatgtttctgtgcaatcgcatacgcttcttctatggtggaagcatattgaaggatttcacgtgccaataaagagataggcatggcagccgataccggcatggtcgatttggcagcattgatggtaactgtcagtcccgtttcattcatccccgacaacacaccggtcatccccgcccaacctacggatgcaaaacagtatccatcggatggccgatagaacgaaaccagtttattacgggcaaaatcatcgcctacataaaagtcgaaattacgcccgatcaataaagtcgaatccgcactttcatttccccagacaccaaaagagctacacccgaccagcatatagtcctgcatagcatggccgatatcatgtgcagcatgataattcaactgacgttcgtaaggagtaccgatcgcatcatattcgtgggaacaggaaagagaaattccatagatttccgtccggtattcttccggtatgtattctcccagattacggttaaacaggatcaggaaaaaacgcaggaacttcagataactgtccgaaggtatgatctgacgtatctgatcgacaaaaacctcttcctggtaatggagcaaatcttctgccagtttcccgaaagcaactcccctttcggctggattcccctgcaacgacatttcccacaacccgcttttgctctgccgtagatgattcgggccatacgtacgcaagctatctgtttttaccagagaataaaccggcagcgattgtatatcgataacaggttgtttcatatctgccgtcaggaaaaggacagaggaggcaatcaaaagcagtccgataaaacagagaaaggacagggtcaggtattttattatcttctttattttcatatcaggcatctcctattttccgggcgagatattccgcccctaacaattccgcacaagtcagcatcgaagtcaatgttacccctaaagcgccatgtacattcaagctttgtccggtcaggaacagattgggtatacgcgtacgaggtgggatcaatgttgtcagcggatttttataattcttcataattccataagccgaaccaccaggggttccggtataatccctgtaagtaaggggcgtagtagtcactattctctcggtattctgtgaaatacccggacaatatcgttcggcaaaagcaattaattgttgtgccttttgcattttaaactcttcataatcagcaccacgctttcctacagtcgtatcttcccagtttttcacttccgacaaatacatgggagaaagcagacagatcacatcggtatattgttcctggacagaagagggttgcatcgagaccatacaagtattaatccgggtatcttcgggataccgggtgttataccaggcattctgatctcccaacaaaaagagattccggttacaataccgtgtactctcccgtttctgaagcagatagacagaaaacaatccgtatgaattaggcaaatgttgcaaacgggatagagtagccttccgtatcaacggagatttctccaccagactcaacgtattgaaaggatgcaaggaagagataacataccgggattccagttgttccgaatgattaatctctacggttcttatttcgtttccggataaacagagcttacttacttccgcaccggtcaacactgttcctccattctgccggatcatgcctaccaaggcatctgccacttgcatacttccatcgacaaagcgccaggatccctgaagatacgaattcgttatgatagcatgatgataaaaagtagaaaccgactgctcaccaccatacagcaaaacactcccggacaaaacctgctgtaaagtttcatccggagtaatctccttgatctgttcccaggcagagacataaaaattatccatattgccggaagacaactttcctttcctcaactgttccacactgatcgacctaccgacagcatccaacatatcgacatagcggtaaagtgcctctttttctttcgggaattcacgggccaacgtctccgcaaaccgttcatgccccatagcaaaaggataaaacttatccttgtagcagatcatatcgaaagcctcttcatccatccgtcgcatcttcaacttatccattattccgaaataagtaaagtattgccgcataatttcaccctcatccatactgccgatataatgaatgcctgtatccaacatcctgccataccgtttaaaagattgaaaacaaccaccgggtaaaggattcttttcgagcacacagacattatacccttctttactcaaagttacgccacaagccagaccacccagtccgcttcctatgataataacatcatatcgactactattgctcatgtgcactctcctttcttctcagaacatagatcgtattggatgtaaaacgatcattagcctgctgctctatctccatccgatgtcgttctgcgagccggataaacatttcatgcgttggaaaataaagatcattctctcttttattgaattccagtaaacgggtagaaagtaactcggtaaaccgggttacccggtgtttaaccgtaccaccggcatcaccgtcacgaataactaatattccacccggcaataacttaccaatgcaggcttccaacaaacgttcctgtgacgaataatccatataatggagcatatcattcagtataaacacatcactgaacgggagatcatagtctaccgcattggcacaaacaaaacgggtacgatcgttcctggagaaattatgattcgcaacggcaatcttatccgcatcgtagtcaatacccagaactgtccgttcttccgaaagcatggcaagcatataagagagcggccccaatccacaaccaatatccgtaatccgggctttacgcggaataatccggttaaaaaactcatatttatcctccatgaggactttaatacgaatataccattcctcaaccggacctttataaatataattagcaaccaactgcctgtaaaaataaggattatccgaatttgaataaatatcacaagtctcctggtaggcattacggaaagcagcagcaatggttttcgaacgttcctgataggtcacgccaaaacttgtatcagtgttggctatacggggcaatatacgggtacacaatacccctcgcttcacataaaacggctgccgtttcgaaataatcattcccgttccatagagaacgaccggcagtatatccaactgcaatttctcagccagataaaaagctcctttatgaaagcgatgtatcttacagtctgccgaacgtgttccttccggaaaaacaaccaccgaatatccctgcgcaaccttatcacgaagatgatgtaagactttctcatacccatcctccgtctgcacaaaatcggcatattgcacgatctttccaaaaacaggggaatgccatacccacctgttcgttaccatcaccaacttcggtgccagggaaagcatgaccagtatatcaacaaaagactgatggttagcaataatcaccgatggtttctcaaaagtttcattacccggatttattttctcacgccgggctatccaggcagctttcaggaaaatacgcagcatatacatcatgatccggctgaacaactgctttttccttttccttcctgcaggtagcaatatcaacagaagcgctactcccatcatcaataaacagccggtgacaaacaagccaaaaaaccacactgtgaccagaagcgcggacaaagtatatggaaaatttccttttgaggcaggccgggaaataaaaaaacggaacaagatcggtaagatcgtataagaaaccaatacgacagagatcattcccaggatcgaaattaccgagatcgactgtaatgcaggatgtttcgcaaaaaccagtaccccaagccctacaaccgcagtgaacgaagagaaaaagatagctgtcttatgggaagtaagcatcttcttgcccgtccggtattcctgttgcagaccatccatgataaaaatactgaaatcatctcccaaaccgaagataaaggtcgaaaggatgatattcacaatattgaactgcgttccggttactgccatcaaccccaggatgattacccagctgacagccatcggggtaaaagtcatcaacgtcaattcgatccgtccgtacgagatcaacaaagcgaagaagatcagaaaagaagagatataaagaatcagataaaagtcatcgttgatagcagagacccacttattggcaaaatacccccgatcaaaaatcaccaatccgtcattatcggcaaaacggtcatagacaaactctttatcatcctcattcaaacgaacctgcgtgataaacatggaaagtgaatcggctgaagaggcccaactgtccagtagcggcaaagaagaatcgccggaagtaaagtcgcaaggagcatattgtttatccagaagagcaaagaagtcatcaaaagtatcggcccggaaatgatatttcccggctttctccctgatttctttatcgaccaatgctttccgttcagctgtccagtagctgttccagcggtcgatacgccgctgctgttctgcataaggaataaatattttttctgccgaagcaaattctttaatctttccttctgttttcaacgtttccagttcacgattcgtttccgcataatgctgtaatccttcatcagaagtattacctaccgaaacgaaaagtgtggttttattatccgactggaaaagattgttcaagcgcagttctgccgccttcaggttaaccggttcgaagctcagattcatcatattactgtcgaacgtcacctttcccgacatataaagggacaggaaaaagacgatcacgatcgtaatgaccaacggcttatttttttcataagcatatccgttgatcttctcaataatacgaagcacccggccggcctcttcatgtcctttctttatcttcaggaaatgcggtaggaacaccaggcaaaaaaaggttgtcccgatcaatgccaatgaagagaacaagccaaaatcacgtaataggtccgaactggtgaaaaccaagccgaagaaagctccgaccgttgtaaagctacccactgtaagcggataggccagttcctcgatcaactgccggatggacgagacatgattaaaatgcgacaatacatggatcgagtaactcagtgccaccccaaacacagcagcacccgccccgatcgcaatggccgacacagcacctttaatgaaaaagatcagagccagtgaaaatacagctccatataatacaggcagtatgatcaggatcacagccgaacggcttttgaataccaatgttataaaaccgataatgatgatcagggcgatcgtcatggtcaacatggtatccgatttgatctgccgggcattgtagacaccgaccgacggtcccccgaaatattccgctttcacaccgggataggcgttcatcgtttctttcagctgcttttcgatcgtatcgatcaggaattcgttttttccggtactgcccgtcccgtaatgcggagtaataaaaagcaacagggtcgacatatcctttgaaaaaatatgcccgtcatacaactcataattagccgtcatctggaaatcgcgcagtttttccagagaagaagtacccagacctaccgggtcacggggcagaatattcttaagtgccactcctgccggagaaagcagattcagataattactacgcatacggcgttcaattccatccggggtcaatacggaatccatccggacataatcagcctccgtcaagaagacaggcaggttatcataaatcaatccggtcaccttccctatcatattctcatccacctccgcaaatatatccgttatatactcggttccggcctcttccagcaaactatctttcagattttctcctgcctcaatcaggcgatcggaagaaaccgtaccggataccgtatcggcagacgacaacataacgatgatcttatctttgatctttaggttttggaatacaatctccgtattccgggcatcctgcgtatcagggaaaaatcgggttacatcttcttcaaatttcacctgtacggcaaagaaaagcaataacagggagctaccgaccagtagcaggtaacggacagccagatggcgttccaggtaattatatatatggataaacagcttactcatccggcagaacgctcaggcttccggaacaacgaaagcaacgttagacaaacaacaccggcaaataacccgcaaataacggcaaaaaccatacttccggccagatactgaacgaacgaatccttgatcgtatcgaatgtcacttcatatacactcagctttacaggacgatccagtatccaccctcccgtcacataactcccgaataacaggaagggaatcacaggagggatactgatattcgatgcaacgatcgtgatcactttgttcaaccccatcaaatgggccaatataccggcaacaatcatctggtatccccagataggcacaattcccataaaaacaccgaacataaccgctaatgcgatccgtatattcgactccggggaatgagtgatattcttagatatgaatttctttatattctccttcgttacgcttcgtacacatttccagggccagaaccataacaaagcaacggttacaaacactgagttcaataaactgatccgtgtaaaatcccgcaacgggcgaaaatgactgacccgctccccagccggtggataaaacactttcaccggaacattcgcaacccgtatattccgccaggcagcctgtacgattatctccagttcgtattcgtatttcgtcgtgaaaagacgtactttcttcaacttgttcaaaggataaagcctgtaacccgactgggtatcagttaagcggatacctgtttccagtgtaaaccagaaattagagaacttattggcaaaagtattttttccgggcatattatcagaagccagattacgggccccgatcaataggctatccggatgcaattctatctctttcaggaaaacggggatatcgtctgcgtaatgctgtccgtccgaatcaagtgtaataacataacggtaaccgatctccatagctgctttcagtccggtattcaaagcatacccttttccccggttgttcggatagctgataacaccgatttcagagaatcctttcagcacttccgctgtatggtctgtggaaccatcgtttaccactataacaggaaatgagtaaaccaatacatccgtgaggacctggccaagagtaatagcattgttgtacgttggaatcacaatagccaattgcccctcccgtcggaaatgatccggaaatgtatatgtagtatctgttaccatttattcgttattactccgcaacaatcgttgcttttagtttgagtacagtcgtctcacctgcacttgcaatagcctgtagcctgttggtattgcctaaaaagaatgcaaacgtaagaataccatgttccaacgggttcacaacagagaggaatttacaactatttatagcttgaaaacgcaccggagtattcaacaccatcgatacgcattctttcactatgcggagcatacaaacaccgggtaccacaggcatacccgggaaatgccctttataaacattatgctccggattcagccgaattacacaagtatattcttcatcttgtcccgcaacggtttctactgtataaaagtcagtcaacatcccttttactatgcatttagtgggacaaaggtagggaagtttttctattattttggtctgtatcgaatctttttcagagtattaacccttctctcacaagagttcctactctaaaaacaagactaatctttattatttcagctttgcttttttaataaagaatttagccagctctcttcctgccttggcatacgtttcctgtacgcgatagcctgcagtaaaatcggttccccagaaattatttgcggaagcattacgaatctttatagaagcgacctgctcgcctgtatcgatcttctttaccttacagctcaggtctaccgatgcattctgccgcataacgccgacattccaacccggttcggtgaaatccgtgttaatctcaatcacatagatagcaccttccgttccggaggtgatgcctttttctcccatgtatttatcgaatagttccagaaacttaggttcaaaacgttccttacgatcgttaacccatgcttttccccattcatcgcccttaccggcttctttctcattatagtcggtgattttcttgttgacatattcactttccgttagttttccgactaacatctcgttatacgagaaagtgaattgcagtacaggggcttcttttacaaagtctattgaaccggaagtcaacacgacactttgtgaataagaaaatgtcaggatactaaataggacaactaatgttatcaatacttttttcatactttaataagttgtttgttactaatttcaaaaatatatagcttacataatcttaggtaaatcctactttaaagcatccaaaccgatagaaagccgtaatcccgtatgtctgatacggagcatttctatcccggtagtgtcgggtagggaacggaaagttgttttacgaaggccggctccgagcttgatctcttgtatgcggtttgttatatcgtccacacgataatatccttggaagccgggcaggaacaatttataaacaatatctgtttgtggttttgtacagctataaacgactgctttattttcaggctgtacgttcaaaccgaagaggaccgagaaatcacgataaaacaggtcgagtatcttctttttattcaatggttcgatacaatgatgtactactaaaccgccccttccgatttccaaatcgaaaaggctcaatccgaaatgggtgctgaaaagcgtacggaaggttccctgatccgtttccttgaccaataacagtccgctgaaatgcttccgcatgaaatcgatcgtcatattgtatttacacaacccggcagaagcatccaccataggaagaagttgttcttttcctatcagtaatgtttcccctttccggcagtcccgtgtgatggacggaacgcacgaacagcagatcagtaaaagacaaagactaacggataacaaacttttcatcaccggtcagtgtattatatttctgatttgtaaagtgatattcggtataatcttttgcattctccgacaggcgcagcgtttgtacagccatatttttcttatctatcgagataacgatctccgagatataagcctgtacacttttagaaaccggacgtatcttaaccacataaagagaaggcgactcataatattccaacttatacgccgatgtcatgctactcaaatcgccaaccatacaggcagccagcatccctttcatttcattcatcatctggttggaacccaggttgacgacattgcttttcccttcggatacgatctttagcttttggccattgataataatctgataatcgaccggtaaggtataatccatccggatcatattctcctgtttataatagaaacgccccttcgagagaaccttctcattaaaaacatccagaaacttctcctgtgtaaaatcactttcaatagaagagagcgaagccgcttccttcttcagccgctcctggaactcaactgtcgaaaccaatggtttcagatccttttgagccgccattggcagataaaaggccagaagcaacaacaggcatatatatttattcattatcatactctttttcaaacggacgaggtaaataaaacattgtatcgagaggaatgacctcataatcgattgtctttaaatattccagtaaacgagccaccagagaggcacagccgggcaggcgatcatgcaacaagataacggcccccggttcgatctgcctgatgatacggcgaaacaccctatcttcagactctctccgcgtatcaaaagaacgaatgctccatccgattattgtatatcccagttcatccgtcacgcgggcgatagtaggattcgttaccccaaaaggaggacggaaagctgataacgggtctgcatacgtgtacaaggcatcttcacctttcaagatttcatcatacatcttcttgaatgaaagaaacgggaacgtccaggagtgtttgtgagtatggtttccgatataatacccttcctttaccatacgcttgaagagttcctggttttccaatactttttcccctacacaaaaaaaggcggccggtgcctgatacttcttcagaacatccaacacctgcggcgtatgtttcgggtcagggccgtcgtcgaaggtgaggcaaaccacacgtttatcggtttctcccttgcacaaggctttcacatatactcccgaacgaatgctgtaagaggcataaaacagataacctccgacacaaaccaatacgactatcaatagcagccatcccatatattaccctttctttattaataaaaacgaatgattgtccaggaaggaattatacaacaaaacggagccgggagaaccggcctcctgcatccgggtacaggcataccacagagcaaacgacatggctgtcgggaactctccgcagtaacgtttatactcatccggcaagaccacagaggcatccgtagccccattccgaagtagaaaagcttccatacgcttaccgatctcttcctgcgtgaaagagccgctgaacaactctatatcccgaagctccgccatacattccgacgatggatttcccgacaacagaaagaaagccgccccttcgcccggctttgccttcttccaaaaacccagacggccgagaatggcctccaaggccggtgtcatttcatcgacagctccgaccagaacagacgaagcttccccttcctgcaaaagtaaagccgcatccaacaaagcactttccaaagaaaaggcacgatgtacgtaagtcgtattatagctatgattaccggtaagcagagcgatctgtgccccgatcgtattaaaggtagactggataaatgccgtgggagtaagcagttcctcgttatgctccaatatcgtattcataaacttctccgtatcggccaggcatcccagccctgtggcggtcaggatcgcatccacaggaacagccgtttccccgatacactgcaatccggtagccacccccatacgaaccatacgactcatacggcggcgaagggttgcattggggatcaggagcttgtagtcaggttccctgagccggcaaccgtcggtcgtccgctcaaaagaggctgctgttttttctatataaaccggctttgtaaacatagtctatcgatcgaattgctggaaaagcagggaagcattgttccctccgaaaccaaaggagttagataatacagagcgaagagtcaatccttcccgataacgggtaacaggaatcaatcctgtttcctctaccggagcggagaaattcaggttcggatagagaataccgtgtttcagggaaagcacactgaatacagcttcaatcccaccggcagcgcccaacgtatggccggtaaaggctttcgtagaactgaacggcggtatccggccttcgaaaaggcggagaatagcccggctttcagaagcatcattattcagggtccctgttccgtgggcattgatatagtctacctcctccggtcgcacccccgctttatccagggcacctttcatggcaaggaaagcaccggtgccttcatcggaagaagccgtctggtgaaaagcatcgttggcattcgcatagccggacaacaggcaatagggaggattggcaagagttgcttccgattgaagcaccaggtaaccggcaccttcccccagattcaacccggcacgcgagctgtcgaaagggcggcaaggttccttgtccaggatcatcagggaggcaaagccatttaaggtgaacttacacaaggcatccgtcccgccggcaatcaccacatcgagcattccctgccggatcatccgggctccgagcataattgcgttggcggcagacgaacaggccgtactgaccgttgtccggaacccggtaattcccaggaaagaggcgatccgttccgtactgtcgccggcatcgtgcgaggcgacatatcttaaccgtccatgtgtcggattggcgcgaaaggaaggataaaaagactccgtcagatccattcccccggtagaggtggaagagatcaggccgatacgtaatgagttatgcggatcggacaagtccagcccggagtcggccaaagcctcgaaggccgccgtcatccccagtaaagcggtacgcgataattcggcggatgccggaataccgagtgcctgcttcaattcctcattcgtccgctttacttcggatacaggttctttatgcgaggtaggaaagagtgtaacaggtcccagcccattccgcccgtcgcggaaagcacaaagatgttcctccacattcatgccgatacccgacacgcaaccgatacctgtgacgcctattctcatttcgtgcggttggcagtgatatagtcagccaacgtttttacagagtagaagatagatttcccctcccccggattcgctatacgaataccatagttacgttcgagtatcagcatgatttcgagggcatcgatcgagtcgagccccaatccttcatccccgaaaagaggcgcttcgttttcgatctccgccggggttatgtcttccaggttcagcgattcgatcagcgattctttcaattcctgcattaattgttccatattgtctgttctatattattattcgtttgaaattatttttgttccagccagtcgaaacgggcttcatacgtttcgcccagcagttcgcaccaaccggtcaggcaggcgcgcagccgcctcttttgcatcaccagccgggcatattccctgataaaggactccgggtagcggtcgttgataaagaaggtattctccccctgtatcttataccggatgcaaagttcgcccatcaccacattcggcaaggtgtagacaaacacggccgggctggcttcccgatcgcccatcgtgtcgataaaacgctgatgcttccggtccgtatccagcgaagacgaggcgttccccaacacgatcccgacttctcccggagcataaccggtagttcccccgttctttgcgaaaagagaggctgccgctatatatccgagtttacaaagatcgtccatcttataaaacttacggtcatccagcgataaaaaggtataggctgcgcggataaatgttgcaaaagggagggacgggtcggcagcgaaaaggatttctccgtcgagaagtatctttccgtgagcgatcgacacctgccggcaggaaaaagaagccgtccggcgggcggaaaggttcttttctacgctgggaagctcgccggcgggcggaaaggtcatttgaccatcgggacaagctttcccacgggcggaaaggtccttttcttcacagggaagctttccgaaggagggaaaagtttctttttcttcgggagaagctttccgaccgacggcgagcttgttttcttcacagccgagctttccgcccggcggaaaggccaaaacgatagcagcattacagccgccgaagccggaagcggtcttgacacaatgttgcatcccgatcgtccggtgcgcagcacttaccgacaaaggaaaaggaacaccgcaggtttcaaaccccaacgtcgcgaatacttctccgctgcgaagctgctccatacaggcgatcgtttcgatgatgccggaagccccgagcgtatgtccccagtacggcttcagactgttgagcggcagatgatccaacccggccaaatgaagcgctttcgactccatctcgtcattatacaaggtagccgtcccgtgcgcattgacgaacgaaatggcatccggccctaaaccggcctcatccattgcctggctgatcgcataatacaaaccatcaccggtacgcgaaggccccgagatatgattggcatcattcgttatcgcccctccacggataatcacggggcgatattctttcacccggtgcgggtcggaggttatgagcagagaaccgcaggcttcccctagcgacaggccgtcgcgtatttcgtcgtagggcctgcatatctccgggctgactgatttaaaagattgaaagccggtgacaacgaagcgggtcaacagatccccccctgccaccagtatatgtttataggcgcctgcctctatcagccgcgaagcgactaccagtgccgaaacaccggaaatgcaggcattggaaatgacaatcggttcgtgtgtgaaatggaaataagcggctacccgttcggccatgccgtaaagcgaaggatcgggactatccgtcggcagcccggtatccggggcgaaggccaaagcgtcgatattgccttttgtagtcgacaggataagtccgcacgcaggctcggaaggatcgataccgctttgacggatcgtgtccgacaaagagaggatgaataattgctccatccgggtgtacccgtccagcttctgcgccgaagcggcttcttttaaacgggtatcgtcaatacatgcagccaggaaaggagtgtcgaaaagagcagtgttttctacccgtttgatacccgagtggtacccgcggatatgggagaaattctcttccctgccgaagcccagcgaactgatgatggagccggccgttatatagctgtttaccggatcttccatttctctttccactttttatagaagtccggattattcagttccagtaatcctgtcgctttgtttacgaagacctggatgctggaacccgtagccaccacagtctcgtcgctttcccgaaagatcacgtattcaaaaagtatcttagccgcatccgtccggatatagcgcgtttccacaatcgcagactcgccgtacttgaggaattgcttgtattgtacgtccagttcgacgatcggcactacataaccggcatcccgtatatccgtataaccgataccgtactgtcgcccgaaagcctcccgtccgtcttccatataacggacgtactccccgtgccagacaacctccatcgagtctacttcgctgaatctgacccgcaaggtcgtgcggttggtaagggctgcctcttgtagttttctccgtttcatgcgtctttcttcaaaaatattttaagctgaccttcggcgaccggatttccgttcacctgcacggtggccgagatcagcgtgatatcgaatatctcctgttctacccggatcgtggtccgcaactcatccccgacctgcggcaacgtccgatagttcatcttatctaccgagccgataaaaccgaccggcacctcttcgccggcattcttatacagataacccacccgcacggctgccgattgggcgatatgttccgtaatgccgcattcatcgagccgtccgtcctgacagaacaggttggaggcttccactttcagcccggtatacgaaccggtctcgtccataccgaagaaacggtctaccatcacgatcggcggacgttgcgggatcagttccaacagctcgtcgccggccaacagaggggtatcgaatgagattgcagccatatttatctgagtttacattgcataatactatgtcccaggccgagcccgtcgtatatccgttcgatcgtcagtccggctttttccaccaggcgagccatatcgccggaataatacatcttgctgttaccattggccattgccgtgaaataaaggctgatctgcgccaggcaataagaggccgtctcgaaacgctggcggtcccagaatgtctccatgatatacaggcggctgtcggcgttcatcgaacccgcggcgcgtgtcaggatactcagtacctgctcttccgagaaacagtcgaggaactggctcatccagatcgcatcgaacggtttcgggaaacgggtctcctcatccaacaagttggcagcatgcccgtgaatacggtccgccccttcgagctcctttgtctgctcccgcatcatttccagctgctggggcagatccataatggtgacctccacttccggtgaccaggctacacattgagtcgcccaacgcccggtattgccacccacatccaataacgtacgtaccgacccggcgaaaacaatctccaacgcctgcttaaaggagttgtcggaatagaaatggtcgaagccgaaccagctctcctgcaccttttcgggcaggctggacaaaccttcgtagacggtcggccagttgccgaacactttcaggccttcgggcttgccggtaagcaaggcctcttccaggtggaaaagtcccagatagttcacgtcgtggttgaaatccatattcacccgtgccatttcatcgttcaacaggaaccagccggctttcccgaggaagaaacggtcgtctttcaacaggatggtcccgatcgtcagcgacgattccagcaacacctgcacggcataacgcgaaaggcctgccttttcaacgatctcatccattgtcagaccgttctgcgcttcccgcagcatgccgaatatcccgaatttaatcatcaggcgcgacacctggaagactaccgggccaaaagcgatctcctgcgccaggcgttgtgcctgtactgccgaaaaacgatcctttgcatatatttctttttgaggagatgataattccatgttctctcttattctatctcttatttccagaagtcatagtaattaaaccactgttccggatattgttttacaaccgattccaacgccgatacatactgcttcagcaattcctgccccggcactttccctttgacacgcttctccggctgtgccagtacaaagttaaacttatagcgcattcccttctcacggacagcgaaataaaatacgacaggcactcccaggcgggaagccaacaggaacggccctgccggaaaagaggcctctttcccgagaaaagtcgctgtaaagacctgcgagccctccacataacggtcgccctggaaacaaacatattctcctttactcaatacatccctgatccggaatatatgtgtcaggttatcttcattcacaggaatgaccttgtagttcttcccgttggtattcttttccaacagttctttgatcttctgatattcggcatcgaacatcacgatattcatcttcttcccgtattcatcgaaaaaaggagcgccgatctcccagttgcctacatgggcaccgatcataactactccttcgcttccgttcaatacctccaggaaatcctgatactgagtaccgaaatcgaaggtatattgtttgtccatccctgcaccgaccgccaccttatcgatcagggtttgccccaaccggtaataattgaccaacagaaaacgggcggaacgtagacgtccatatcctaaccgctgccgtgcatatccccggatcgcccgggtcgccttcggggcaaacgggacaaagtagaccacaaccagacaaagaaacgcatacgctgcctttactcccagtccttttatcaagagaataaagaagaggtacccgaaagaacctccacgcgttttacctttccagcctgtatcgttactcattcacacgtgagtctatgaaatcgtaaaagtcctggaatgttttaatcccgacaaaatcctgtgccttcaatgtaaacccgaagttatgttccaccagtacgaccatgtccaccaggtcgagactgtccagttcgagtgtctgcatcaacggggcatcgggctgtatcagttcaatatctatttcgaactcttccgatagtttctcgtttattttttgaattaattctgtatttgccatttgtttgcttattgactactaagatttgaatttcctgattattaatgtagagttggtccctccgaagccaaacgagttggacaggaaggtatcgaattcgagttgctgagtctccgccgggatattcagtaaagcggaagcctcgtccggttccgtaaagttcaggttgggagcgataaatccgttctgcatcatcaacatggaatagatcacttcgcttgcgcctgccatccacatctcatgtccggtcatcgacttggtagaagccacatacggagctgcttccccgaaaacttccgcaatggctttcgcctcgttcaggtcgcctaaaggggtggaagtggcatgagcattcacatactgtatgtcgcgggctgccatacctgcgtcttttaatgccatttccaatgaacgccgcggaccgtccacgttcgggacggatatatgttcgccgttggaagagaatccgtatcctaccacttcgcccaggatattggcacctctccgcttagccgactcgtaactttctataataacggtcgcacctcccccgctgggaaccaggccatcgcgatccttgtcgaacggacgggaagccttttccggctgatcctccctgacagagaaagcggccagtccgtcgaaactaccgacggaatacatattcacttcctgcgctcctccgcatacgatacaatcctgcatacccgaccggatcaggaaatagcccataccgatcgcatgcgaaccgctggcacacgctccggaaatcgtaaaattaaccccgcgcaatttgaagataaccgacaggttcatggtgacggtcgagttcatgctctgaaagatagatcccgaaccgaccaacgccgtattctttttttcgcggatgatatccaccgcattgatcacaggagccgtactgctatcgttaccgtaaaggataccgacctcatgattcgacagatactcgtcgtctatcccggcctgtgctaaagcttccgcagtagccaaataggcatattcgccctgttcgggaaggccgagacgctgcctgcggtcgagtatgcctttcagattcggcttatccaacaggccggtcaatgccgaacgatagccgaactctttccgtaccaggtcgaggccaatacctgactgccctttatataatgatatttttacctcctcctgattctttccgatgcaggagtaaatacccatccctgttattacaactctattcataaatctttatatcaggtatataacccaccgtttatagaaatcacctctcctgtaatataagacgcagcgggcgaaacaaggaaagccaccaggtcggccacctcttccggttcgccgaaacgaccggcgggaaccaatttcttcaattcgccttcatccaggtctcccgtcatatccgtacggataaaacccggggccaccgcatttaccgtgactttctttttggctacctcctgggccagtgctttggttgccgcaataattccgcctttagctgccgaatagttggtttgccccggcattcctttgataccggacagggaaacgatattgacaattcgcccgaaacgtttcaccagcatgtccttcaataaaggctgcgtaacgttaaagaagccggacaaactgatgtcgagtacccggtgccattcttcgccggtcatccaaagcaacaagttgtctttacggataccggcattgttgatcaatacctcgatataagcatccggatgcttatccctccacccgctcagggtggatgccaccgattcagcgttcgtaacatcgaatttaagcaactcgccatccgaacctttctcacgtatcaactgcaaggtctgttctgcttccgcatcgttgttttggtagttaaccagaataacgtatcccatctccgccagcttcaaactgacggcacgtcctattccccggcttgcgcctgtcactaatgcgtatttcatacaattggttctatattcttattcttcaaccagtcgaccattgtcgctatctctttatatttaggcgtatcttcggtaaacacagggaagaagctacgtatttcattgtaaatatcccgggtacggagcgatagcttatcctgtatcttcaggcaatctacggcctgtacgatagccatataatggatcgccatcacctgatagccattttcgataacggttttggcaatcagggccgagtttgtccccatactaacgatatcctggttatcattattgttcggaatactgtgtacatacatcggatttgaaagcgtctggctctcagccgttgtggaagtggccgtaaactgagaagcctgcaaaccgtagttcaatcccagtacacccaggttgacaaacggaggcaagataccgttgatacgatcatggaaaagataattcaactgtcgttcggtaagcatcgtcagttttgttacggctattttcagtttatccatttcgaaagagacatagtcgccatggaagttaccgccatgatatacattttcagtctccgggtcgacgatcggattatcacaggccgaattcagttcgtctaccaacactttttccgcattgagcatttcgtccaggaccggacccaggatctgcggaacacaacgcagtgagtaataaggttgcaccttgtgttcaaaaaccttttcggtatgacggcaatagagttcgttttcccgtttacgcaccgagctgcttccggctacccattcacgcatggcacgcgctatcgtttgttgtccctgatgttgcttcgttccattcagggcaggcgacataaaatcatcgtatgaagaagcgatctcattcatcataacagaagcgaccaccgaccaggccagtaattgctttgcatagatcaggttgaccataccgataccggtcatcaccgaagtcccgttcgtaacagacaatccttcgcggattttcatggtgaacggcttcagcccattctccttcattacctccgccgtatcgcagcatttccctcgatagaacacttctccttctccgatcagggtcaacgccatgtgagcaagctgcacaaggtcgccactggcccccacactaccatgttcaggaatgtaaggacaaatatccctgttgataaactcaaccagcaattcaacaagttctacatgtacacccgaatacccctgcagaaaagtcatcaaccgggcaatcattgccgccttgacatacaaaggagataaaggggcacccgcacctgtcgagtgactgcgtatgatattgtattgtaattgtttcagggaatcatcctcaatgcgatactgagccatcggcccgaaacccgtgtttataccataaataatcttatccgccgaaaaacttttcaaaaaagtataactgtggtttactttttccagggcttctgcggataatgtaagtgtcttttgctggaacaacaaggcccgtacatcattcagggttaagttagcatccgggttatataatatatccttcaacatatgcatctttatattctcgtgcaaaagtagttcttttgctcaagtatacaaagctaagttgcactttaacttaaagttataagcatcatatctgtcattacaggcttttcctcaaaaagatgaaagtcaaagatgaataaatcaataagatgtcaccgcactccagctacccgacacactcaggttatccacgccaagcaatggtaaattgacaggaacagaaatcgtaatattctttatcggagccaaaactaagtttaatataccgccaagcaaaggtattcctcccagtatgccatctatatttgcaatatttccaagtttcacattcagcgtaagcgagtgatttccatctgtttgttgtgcatacgacttaagacgcaagtccagaaaagaataatcggctttataacgcctgttcgtttccacattggccgttacaggatctgtaatgtctataaaggcaccattcaacaaaagggggccgtcgatagtattctcgatcagaaaaccggatatgagcccgtcacgtatggcactgatgcgccgcacatcgaaacttccatgaaaaccgcgaataagaatatctttttcatcatatactgttccaccggtaaagttaaacctgaaacgattcactccggaataatagtctatcacattattattcaagtctaccgactttggaaaattattgatactcacaatagccgtacgtgcagagtctcccacccagggattcaacaagactccaaggccactcaatgcaccttgctgagtcgtatttcctgtcaacgccatcccgatctgatttaccagttgctgtagcaaaatatcataaagagcattcgttacagggatcagcaaagcatcggctacagcatttactgtcgcatcaagaagcgaaagggccgggatctgcttcaacaaatatcgcaatgagcccggagcggttcctcccactgtggtttgtatataattcttatactgtatttgtgtgacgatattattaacaagttgattcagggctgtctgtgcatccacaaaattacgatgtaccttaaacattccgatgatccgttgtaacacaatatacggattcggcgtggtaggtgaaaaactcaccttcgcctcataatattccgaagtatcggaaaaaggtccactaggtaatacgatacgggcatccgacatctgccctttgtaattaagtagtacatctgccactccttgtcctcctcccgtaaccggataggggaataggttcttatccgtgtttgccaaaaaaacagccgtatagactccctttggcaaagtatctcgtatagcaggtaatggccaggtagttgttccggaagtcagaggcagcacctctttttcctttacaaacatccccgattcattataaacaaggtaacgaagatgacgaacccgcccatccaggccactcacaggagttcggctcataccgctctccggtgagaatgtcactacaaaatatccctccgggacaacacccgaacctccgtcatcaggagtctctgtcggcttttccgtttcaacaggcaccaattcttccttctcacaggctgcaaaaagcaaaagcggaagcaaaccgacccaaacaagaataaatgtcttcatcttcgttactcttttaatagttttgaataccatcccaggcattatcgtccagattaatattataggacaaagtaaaacccaggttgattttgttgtaatcaccatcaatccgcacccaatggtttggtgaaaatataattcgattgccggagactacatttgggacatccgcaatctttaccgtatactgttccgtaatacccgcataaatcacatccaggtacaaaagggttttacgtgcatccaaagtaggcaacataaacatgttgaatgtaactttccccgatacgggagtcaataatcccagcgtccttaatccggtatccccgacaacctgccattggacaggagtaccatcggcagccttcactgctgttaccagttgttcggctctcaaacggatagaagtcacataggcgggaatattggtgatattcagcgttaaaccactggaaatccgggttaacgtcccttttatattatttatctgttccggcttaaataatcctccaaccaaaacagccccattatacccattacccatacaagaaaaaagttcgggaacatccggagcattgatcaatttcaaattcacatcagccaaagttgacggccgaccggttattcccagatcgaaacgtctcccggaagctgtcggattaacgaaatcataatcattccgattataacctatcaccattaactggtatgtggagccggtagacatccggagcatggccgtattcaaaggaaatgcatttatatcaatctgtttagcggctgtataatccggtacgaaattaaccggatcattcgccaaggattcgttcgtctttttaaacggcaggatcaatacccgattcacggaaggggtagcgtctcccaacgcacgggtaagattgcccccttcttccatgatcgacaaaggaacagaaaccgttccgacttcctgatcgaaaggaatatcatccgtagaacaccctcccagccataaagaagccaggagagcggcccaaaaataaacatctgttgtccgacgcataatattcatacgacattcagtttaaggagtctgcaaaaccaaatcgtgaatagcaatccagttaggagaaatagtgatcgtgattgtttgatctgtcagcaaatcgatcgggttatcgtcatcattcggatcatccggatccccaacagtactgcccgaagtcactttcctacctaatgtatagaaatgattggccaaaatatcgaagctcgttcccgttccgggagaagaaaccgcccatgtcctaagagctgttccgctcgcatcatacaagcccaaagtcattgtaatagcattaacaggaaccagatatttaccactaagttgtgaattcgccactttgacaacaccagcaccagccgtatttccggtataaacatcatttgccgttccttgtgtagaaaggtcgatatcaatgatattgtacggagtggttcctgctgtcgatccggcacctgtagaaaggttcgtcactttgttgctggtcgaaaccgaaagccgaaggtacttaactgtagttccgtctactgttgtcggtacattcttgaaataccccagaacaccggctattttacgggtcatctggatactgacacgactaccctgagcaatgatcgtgtaaggggtagaaccagcgaagatctcagtttcatcacctgtcgcggcaatagtagccaccatgtcttcaaacttagtgctggaaacagtaggcgatgttatcgtaaactgattatctgctccgacccctactgccagaaatttataatcacccatagtcagcttgttctcttccggaacggaaaaacgtttaaaagtcgttccatccgtccagcctgcgatattgtatgatttctcaaacaaataatcagcaccactgctcttaaatgcatacacattcacctccgtaacatgctgcgtagcctcctggctataaaccggagcacgtgtcaccgagccactctctatctcattcactgctgacagttcaaaagtcactgaaccattttcactctctactggatctgcattgtcttcatttgaacatgaggcaagcattagtaaagaaattactgataaaaaaacaacacttttcataagccgaaaattattaagtaaataactagaaaaaagaaaatattatttggtgtttaagatatccaactgatgaaccatagtccattcttcattaatatacgtccatatctccagagcgccggtaattttattatagttagcctctatagctgttatataattccgtttcataacaagaagtatttcaggaacaacaagttctttagatgcatccgtagccgtgttggaaaagaaccgaagatgcaatttcgaacttcctcccgttacagaaggcgccagcatagtctcaatcaatggtttaacaggccctgttttgagaacggtcgtatttcccatatacttcaggtaaggatctaccgtatcatataatgaggtaactttttgttctacctgcgttatcccggatggaaaattcgagcataacaaaagtaaatcacctttagccctctccaacattaacaaatcagaaaaagtttcagaagtaaaagagatatttttattggcaacatacgtatctgtcaactcattaccgttattatgcaacattccggttgtcattgccgtttccgattgtatgttaccccatacagtaagattataatcaccctgaggtatattattgaacttaattgtataaaactggtcaccatcacttaacgcattatctaatttttcttcaacaattttccccgtttttatatcgcgtaactgataatatatcgtacctataaaagcacgataaggtaagttttcatctttttttactagctgaaaaacactttctatatttgaataattcttatcctttacatatacttttacagtatgtgttatcacacaatcatccatatcttcttttatgcaagacgagaacaaaaaaagcataccaatggcatgaagaaaatacacaattcttctcataacaaaacaaatttatcttgtgattaacttaatacctaaaataccgaccaaagtcattttaaacaccaataaaggacagaggaagtatatttttttcgatttgtatatagaacagaagatgtaaaagatttgtttaaaaacagaatctcctttttggttaaaaatcagccctttaaaagttaaagtaatatatatccgatttcacatataattatagtggaaaaccattaaaaacaccttggaagataaaggaaatcagacaaagaaatcgaaaggtaacaaaaaaagaatagagcttatataaaatataaactctattcatccaattttacgactaactaaatctgttagttccccatacactcaaaaaacttttcaaacatcttattgcttatagactattacttccttctttttcaaatactccatgcaggtggtcgccccattgatttgtcagatcgagaacataagtatccgcatcaaagccacctaaatcaatcatagtataatctgtttctgaagccgaaactttcgcttcgtaaagaataattccatctttcgatatacgtacaactatatcagaacgttgactggaactttgaatagataagatatctccattaacaaaagcagaaatggggacttttgcagaagcagaacgatgcccttctccccaccaaccgccaaatgtaactacggacattgtcttggcagacaaatcctgtactattaatccactaaaaataagtacaaaaaataaacatacaatccatgtaaacatttttttaccctttaccatgattttaattatttaaaatgattaatacatagcaaagatatatgttttacaacaaacaaggaaaggatcgacgtggacatccacaaaccccaaatggctatatataagacaattacaaattgccatattcgtagaatacggacaaatcatttttcaatattcccaaagaaaagcatcgactgaaatttccctatccaagggagtaatcaaatgctggctgattcgttcttttaaacgttgtttccgtttagttacggaagaaggggaaattcccgttaatgtagctataacggagttgcccaaatgcaattttatcagacaacaaatccggagatcactatccgttaatgtggggaagtctttctgcaggcgataagttaaatcctcatagaccatattcactaaatcgaagatttcattccacttatcatctgttatataacgaggagatactgccaggttatttaacgtttctatccgtttaaccaattcattacaaagaaacttttcacggtcatgtaaaaccgtattttgaattgccaaacactcataagtctctatctctattcctttttcctgtaacttataaatgtaattctctatattctcctgtaaaagcttattttgaccaagtagtgattcattcttttggcgaatacattcaatttcaaaaatcctatcctgcaaagactcctgtaattccgtattctcttctatttgcagagataacgatttgatcagatcttcatttctcctgatatctacctcattctcacgcaaatgaaccaaatgagactgtaactgctttttcgtttcctgaacatcacgttctttacgcaataatttacgttggtaaacaaatatcaatgagccgattagtataagcaataagatcagaatagacaaagcactttttataaaatgacttttctgaatcaacaattgattattttcatttaaaagcttttgccggtcatacttcacctgtatttcagtcaccttcatactacgatttatattctctaccgaatccatatacattcgatataaatcattatgtgctattgcttctttatattttccgaaatcccgatacaaatagtataattcctggcttgcatttcttttgacatatacattcgtggtattcaacgcactttctaaataataataagccgaatcaaactgtcccattaaccgatatgtctctcctatacctaaacgtatctgagaaaaatcaagagagccagacctttcatctatacctaacgattttacctgataatacaaggatgaatccaacgcccccattctggtatatgccattgcaacttctacacaggccaaagtcaatgcccttaaatctccacattgttcggcaatacctatagcttctttataataacccacagctttttccatatcgccacaaattatagaagcacgccccaaataagaaaaagaatatgatatagtaccactgtctcctaataacagtgaataatcatgggcaagcttataggcctcagttgtttgagtacataagtctctgtgaagatataatgttcccagatgggagtttatcaaacagagtaaattataatcctttgtattctttgccacatcccgtgcacgcaaatagaaagtagcggcctcctccgccctattcatatcaaagtttacacgcccttcataatataatgtagtagccttccttaccgggtcatcctgtttttcgaaatattcgagtgctatatttattaaagaatctgatgtatgctttatgtagtttttatcacgagcctgtgtcgtaagcaaacaccaggtagcatactgtaattcattttctggagctggtatctccattgaatcaagaatagccagagcactgtccggatggctctgcattaatgaatcggcatgcaccaactcagacggcaacacttcaaagcgtttattacacatcacaaaggttaacagacagagtataaggtaaaaagcgcttttcattcgtttgttgtgtgttattcaaggtggaaaattagtaatttttccattaattcaggtactattatatagattatatcatagaagtaggcttgatttcttgattcccaaactcacgttcccgagttttctcatccggaataaggtaagtaacctgtatatacactttctttccttgctttaaagcgacaaaaccaatctcttggttatctttctgacccacataataatttttacccactcggcgttggctggtgagcactttaataatgcctttaccaatagattttatcaaccataactcataaacaatagcaaatattgtcacatataagttatgtttaaatgatctcttcaaattttttttcttatctggctcaatctttgtggcgttacaccaatgtaagatgctaaatattttagtggtatatttttaggttgtccctgcctcagggagaaatacgagtttgcgaattcacccgggaaggaaaaccaaaatgttatttccttatcaggatctccttcggcttcttttgtccaatagcgtagaataccactttcgataaaatatagatacttttcaaaatcacctatctgaatagcaaattcatttttttttatttcctgacgctcaaaatggtcacaaaaaaattgttgttcctctgatgttaatcgtacccctctatttatagagtctattacattgatcgattgttctattaataatgcgatgttcgatgtttccatgatattttagttaaatatcccaattggtcacttaccaaaaggagatgggttaattgtaacaaaggtatcgcattatcttatacactatttgtattcatttcaacataataacaaatagtatagtaccgatacgtcttttggagaattcggaactatctggcgagaacattacaaatcgaacgataattggaactattgctttgaagaacgtggttccgggctggaagactggagtctgatgaatcggatcaatcagattataaaacagtaaaacaaggaacatattgtcattcgctaaagagacagcggaaagatgcatcgactggcagaatatcttcaattctatcgacaaacaaataaagtattgtacaaatattccataattatccctacgtggggaacaattccctacattgtgttgtatatttgtctttatcctttttggttgccgataattatcgacaggcctgcttacaattgtcgacaagcttgttcataattatcgacaggcttgcccacaattatcgacaagaaattatgtcggcaggaaaccagagtgacatcacattgtttttacagacacattagtataaaacaagaataagaatgggaataaaattcaaagtgcatgagactccgcagccgaagagccggcaagggaagaaattaagtcatgcacgggcagtatccgacggtacagcgaaaatggactatctatgcaaaatgatctgctcccggtctacaatctcctcggcagacgtaaaagcagtgctcgactcttttgcatgggccatcaccctatgcctggaaagcggtcagcatgtggaactggaggaactgggatatttctcaccttcactccgtacccagccgtctgccgacggaaagagaatgacggttatggtggacggagtaaatttccgttgctcggaaaagctgaaagaaggattaaaaaatgcagaactcgaacatgttaagactccggctaaactgacactcgacgaacgggaaaagaagatgttggacttcctgcaacgaaacaagcggatttcaacactcgattatgctgaattgaatggttgttcgcgttatcgtgccgttgccgacataaaacgatttgtcgagaaaggtgttctttccaaaataggaggcggaacgcatgtcatgtatgtattaccgattaataatgaataaactaattaataaccgaatgaaacaaaaacaatttttaatcttttccctgttaagcttcttctgcctcttccaactggcagcacaacaggaaatgcaaccactgcctatcgatccgcaggttcgctacggtaagctgtcgaacggattgacgtattatatccgtcacaacgaactacctaaagagcgagccgacttctatattgcgcaaaacgtaggctccatattggaagaagagaaccagcgcggactggcacacttcctggaacatatggctttcaacggatcaaaaaactttccggataaagggatggacgaattcaccgagagtgtaggtatgcgcggcggtgagaatttcaatgcttataccagcttcgatgagacagtgtatatgatcatgaatgctccggtcacccgtgaaagcgtagtagactcctgcctgttgattctgcatgactggtcgaacttcatcacactggccgattccgccatagagaaagaacggggcgtgatccgtgaggaatggcgtacgcgtcaggatgcgcaggcacgtctctgggagcagcaactgccgaagatgtatccggacagccgttatgctcaccgcatgccgatcggaacgatcgatgtgatcaacaacttcaaaccgaacgaactacgcgactactaccacaaatggtatcgtcccgacctgcaggccattatcattgttggagacatcgatgtcgataaagtggaagcagctgttaaaaagatctttgccgatatcccggctccggtaaatccggctccccgcaaaatgtttgaagtggcagacaacgatatgccgctaatctccattgctaccgataaggaggcctcgaacacgatcctgtctatcttctacaaacatgaaaagatgccgcaggagatgtatggtacgattgccggagtggtaaaagattatatccaaagcgttgcagccacgatgatgaacgaacgtttcaacgaaatggtgcagaaagccaatccccccttcgttgcagcacaagcttcagacggtgattatatgatatcgaagacaaaaggtgcctggtcggtagccgcattggttaaagacaatgaagtggactctgccatgaatgcgctggtcacagagacagaacgcgtaaaacgtttcggtttcactccttctgaatacgaccgggcccgtatcaacgtgctcaaacaatacgaatcgctttacaacgaccgcgacaaacaacgtaacagtgccttcaccaacgaatatgtacgccactttaccgaaggtggatatattccgggtattgaaacggaatacgcgttgatcgggcagatcgcccaggctgtcccggttgaacaggtcaacaaatatatccaggatatgatcggcgaacggaatatcgttatcagcctgaccggcccggaaaaagaaggtgtcacctatcctaccgacgaacagctgctccgcgattttatgaaagcgcaacgcattccggtagaaccttataaggaaacactttcgaacgaacctttgatctccgaactaccagccccgggtaaaatcacggagagcaaagaggacccgttgttcggtgccaccgtactgaccttaaataacggcattaaagtagtactgaaacatactgatttcaaaaaagacgagatcataatgacggcaaccagcccgggcggaagcaccttattcggaaataaggatatcgacaacctgaaagtattcaacgaagtcatcgacctgggtggcttgggaaatttctcggctatcgacctcaacaagatgctggccggcaagaaagtatcctgctctacttcactgggaatggatagcgaaaacgtgaacggctcatccacaccttccgacctgaagacgttattcgagttgatctacctcaatttcacggctccgcgtatggatgaagaagcgtacaaatcttttgaaaaccgtatgatcgcccagttgaaaaatgtggaactgaatccgatggtagccttcagcgactcactgacgaaagcgatctataataataacccgcgtgccatgcgtatcgatccggccgatttcaagaatatcagttatccgcgtatcatggaaatgtacaaggaacgcttcggcgatgcctccggttttgtctttactttcgtaggaaacatcaataccgacagtatccgtccattggtggaacaatatctggcaactctgcctgccaacggtaaaatagaacagggaaatgtaaaagaggttccgcccatccgtaaaggtgaatatgtaaatcgtttcaaacgtcagatggaaaccccgaaagcttccgtcgtaaacttctattccggagaaatggattacaacctggaaaacatcatcacggccaccatgttgaaacaggtgctcgacctggtgtatatggaaaaggtacgtgaagaagaaggcggcacatacggtgtacagacctctgcccgtatctcttctttccccaaaggacaaaccttcctgcaggcttatttcgacaccgatcctgacaaacgggaacagatgaacacaatcgtacgcaacgaactgaaacgtatctccgatatcggtccccgtccggaagatttcaaaaagacgcaggacaatatcctgaaacgtcatgcagagaaccaacaggaaaatagttactggctgaatacgctggataattattactataaaggattcgacgccgcaacgaaatatgtcgaaacagtcaacagcatcactcctgccaaaatacaggccttcaccaaaaagctacttggccagggaaatagtattgaggtggtgatggagccataatacgatataacattcgccaaatttaaaataagaaagtatctcatacgagttctgtcctattttaaatttggcgattttattgaaatatcactttgtttattttacttttgtacagaaaactacgaatatgagaactttatcttacttattttctatccttatagtctttttgtgcatcagttttaatggatattcgcaagaattgacaaccgaactaaacactggttataaagtgggagattatgaagtgtttgtatttaccgaaggttcaggagatgcggaaacgggcttattgatagacgcgccaacagatataacagctaaatatgctccaaacggaaccttcccgatcgcaacaaacgtcgtattggtaaaagggaaaggcaaggtatggctcatagataccggctacggatggaaaattttcgagcatatgaagaaccttggtgttgaatgccaggatgtagaccaaatactgttaacacatatgcacggagaccatgtcggaggaatgctgttggatggaaatccagttttcgtaaactcatcgatagccgtaggtgacaaagaactggcttattggagcagtgaagtagaaatgaacaaattccagcccgatcagcgcggaaattttcatacagtgcagaagataaaggaacaatacggtacaaaattcaaaacagtacaagctcttgcgctcgacggggattacggcgacggcatcttcccgatagaggcctacggacataccccgggacatataatgtatctcatctccgacggcggcgaaaagctgctggtatggggtgacctgacacatgccctggctatacagatgccacaccccgagatatcggtaacctatgacgtcgatcccgacatggcacgaaaaacacgcctcaaagtgttggaatacctagccgacaaggacatcactgtaataggaatgcatgttccggttccacaaccgggaaagattgtgaaagatgaaatttccggaggatacaagtttttatcaaaagttatccggacagggaaatagtattcattagattatatcaatgaaaagttatactatcagatgaactcctaaagataaaggaaggagagtccattatttgttttttaaatagcttcattttctgagaattacaattatctatgactataacgattctatttttgtcttccaatatcccccaataatcaagattaaggttattcagttttatttgattctctttcttataaataactacgtttagactatctacaatttgcattaaggcattatatgaatattcacaagattgtacaataaactcactaccttccaacatctttactaaatcttgtttgttttctattgtatctcctgtaaccaaaatagtcaaaacaccatcactattattataactaccaccataatagtcaggaagtctattttccaatgtcatacgcttcaatattttaatatattgtcctgttatattcagctgcctcatacgtatctcattttcaagcattgaaaaaccaacaaaagtatcattctcacacgaatactttattttacttgtacataaatcagtatcaggaactattatcaattcatacactgttgtatccgaaagaattgaaacaggcattattactgctttatcatcagaaattatccgctctttctttttttgtccgcaaccatacaaaaagaaggtaattgagattagtatataaatcagtttcatataaaaagaataaatgtggatgctaatataagaaataaataccccatcacaacaggaaattactttatcttaataaaatatcattattactgaataacaattcatcaatttatctggtaatacaaagcacctttgtaatcaatatctattgttaaactaataaataataattgtatgaagagactagtattagcattattcatgatgacagctattttgtcattcgtgtcctgttcttcagatgaaaacatccaaccagaggtagagctgaagactgaaaaaagtattttcttgcaaacgctagagaatgaaaaaagttatgataagcatctcgaagcttgcgatgcgtatgaaaacctgataaactcgttcaatagtaataatacgaaaacacttagtactattaagtatccggaatattatggtggatcatatatagataaagataatcagttaactgtatttatatcaggtaccacaaataaaagtatggataatcaaatcaatatcaaaaacattgctgcaaatgaaaatattatttttatgccagcaaaatactcctataatgaattgattgatattatggatcgcatacacaatgtagctagtaacaaattatctatcagtcaatattttgatttttggtggatagaagaaagaagtaatagagtgtttgtttttttgaataaatttgatgatggagtaattgcagaatttaaacaaacggtatcagactcaccagccattgaatttaaacaatctctaggtagaatacaaactgaagcatctctttcgccaggtcagcttatttcaggaaccatgtcaactccaagttctgttggatatagagtaaccagatatggtcaacatggagttattatggcaggacatgcaacttttaagaatgaagtatttcgcgtcaacggcataaatgttgcaaaatgtgaaataacacaggagcagggaaatattgacgcagctttttgttcaacaatggattacggtacttctcctgataattacatttatggaacaggtaacgaactctcaacaacaacacagcagccaggccccggtacagcaatcaataaatgtggttttaggacaggtattacatccggatatgtagataatatcaatgccgaagcaatcgcaaccaacggaaatgtactaagaaatctcactactgcttcgtataatagtgattcaggagatagtggcggagttgtttatacctatagatcttcctcaaatactagatacacctgcgggattcatatgggacgtcttggttcttacgcaatatttgtaaaagccgatgaaattaactacgcattaggcacgaatagattctaaaagacatagagcctgagcaataagttaagttcaaaacgttttcattagtaaaaaagattacaatcatgattgaaaactattaacttcagactatatttgttcaggctttttattactatataactatctgatgaaagaatttaaatatctacaattgatacttatttgtttgtttttttcatgcaaagagagtaatcacactaaagaaaaaattatcgagaataaaaatgtgattaaaaacataaaatcagacaaacaaggaaatgcagaacaagcagttcaagaaccggcatttaatgattaccaagaaattaaaaaactttttgggaatggagataagctacgtctattaaaaacgaaagattatccatcatattatggaggatcatatactaataaaaaaggtcagctcataatattcataactggagataccttaaaagcaaaagagatctttagcgaaagaacaaataagacaaatactatttttcagagttgtgagtattcttatcgaactttgaataaaatcatggacactataagttacaaaacaaataacaaaatacccacgtcaaaatatcttgattattggtggatagaagaaaaagaaaatagagttttcgtcttcctaaataaattgaatgatgaagttatatcagaattcaaacaaaatataatagattcaccagctattgttttcaaaaaatcatcgggaagaattgtttatgattaatatattaaagatatacaaaatatgaaacaagtcttcacaatattgactatattactattcctttgttactgcacaaaccctgacaaggataattctattaactcaaatccagatttggctcaaaaaaagtttttggagcaaaagaacaagtcagaaggtgaagcttatccccttaaacccgaaaattggccaagaagaatttcactggcaacatatagaaaaaacttattaataatcagagattatcatagagaaaagaaaaaatacccagatttctatggtggaaattttaccgatgatgattataatcttataatttatatcgtaggagatactttggaaggaaaaaaagaaatggctaaaattcttaatagtacagacttttctatcaaatcatgcaatttttcgtataaccacctgacaaaggtagatagtatattgactaaatttcttcaagacaaaaaaaacagttctatgattgatagtatcaagatagtaagtcatatgctgaattttaaagacaatcacatatctgtaagactaaaagaatgtaatgatactattataaatatctttaaaaataatattttagatgatgaatgcattgtctttatagaagatagttccgatgttgttcctgtgataatatattaattttttcatctttacactctacaaaatgaatctatattaataaatgtaaggtattcctcataaattttcctttttttgtttgatggttcaggcattattttatctttgcgctgagacatcgaaaatacaacgccacataaacacagaccgtttaacaaaagaaaaattatatggaaacaaatatagctttactaatcgaacaatctgtaaacacactcgactccttaaacagaggtttacgactaaccccagaagaacaattatttttctgtgaacactttaaacgggaagaaataaagaaaaatgagttttctatcagaatcggtgattttgagaattacctttattttatagaaaaaggcattcttcgttattggactactaccagccataatgacccagataaagaaatcaccttttggttttccttccctggggaatttgcaaactcgtatttttctcttaagcagaaagaaccttctcagataaatattcaggcactgactaactgtgtaatctggaaactggcaaagcaagatttagtcgatttatatgaaacctcattgaatataaataaaatagcacgaatcgttctagaagatgctttagttcgaaaaattactcgagaaatacaattgttaggactttcatgtgaagaaatttataaagaacttatgataaaaaataaagaatttattcaacaaatcccattgaaatatatagcctcttatataggagttactccccagacactaagtcagattcgtaagaaaacacattaatttataaataaaactgtttaccatatgcaaaacaaattcgacaacatgacgctgaaggactttgagaaccggggagaagaccttttcaccagagcaaaacaaatagatgattatatttcatacagacatcagattcaacatctgccctaccgtgttatctcgttaacaggttcaaatgcgcgaatgaaactgatagatccttataacaacaaagaaaaagaagttatcagctatgtttcaaatgattacctcggactttcacatcatccggaagtcattgaagaaggaataaacgcccttagacagtacggagcaggggcaggagctagccctctgattggtggtcataatctcctgcacgagcaactagaacaggaaatcgcccgttttctgaaaaacgaatatgcgataacatatacctccggatatggagctaattcaagcactttactctcactaatggggaaacaggatattgccattatggatatgtttacccatgccagtgtttttgatggctgcttatgtaccaatacgaaaagatttttacataataatgtagattcccttattcatgtactaaagaacgcaggggatttcaaaaataagtttgtcattattgacggagtatattcccaggatggagacattgccccgttggataaaatatatacggtttgtaaagaatttggtgcattccttattgtagatgatgcacatggaataggcgtattaggaaaaaccggcagaggaataattgaagactatggcctactggataaagtcgatatgataaccggaacattcagtaaatctttcggatgtgttggaggatatgcgattgccagaaaagaaattattactttattaagatactattcaagacaaaatattttctctgcagcagcgactccacaaacagcggcatctgctatcaaagcaattcagcttattgataaagagccccaattgaggaagaaactgctcgataatattgattacttcaaaaaaggacttgaacagttatgcctggactttggaaatacagaatctgctatattccccatcatggttcgcagtgaacaaaatgtaaaagaggccgcccgtgtcttgtttgatcggggcatatatgtaaatccaatcagctatccagccgtccccgaaaaactatcccgacttcgtttcagtataacagctatgcacacaaccaaagatctggatgaaactttagatattctgaatcaattaagtacacatataatcttacgaaaaagtaactaaaaaacaaataaagaggataaattcatcctctttttttatctttgatccgtaaaccttaaattagacaacaatgtatatcaggataatactattatttatcattccttcattcgtttgttcaggatatgccgacgggcaatcagtatccgataacatcgaaaaaatgctgcaaagccttgactcgctccttgctgaaaaagagacttttgtcgttgccaaagagaagcggatcgaagaactgagaaaaatggaacagaaagtccaaacggaagaagaacagtactggatgaacaaactgttctatgaagaatttatggtatacgacagcgattcggcattaagttacatacagaaaaacctgaatatcgcccggaaactgaataatccgcagtggatagcacaatggaatatcgaacaatcttttatattatcggctaccggattcctgaaagaagcactggatgccttgaatgagataaatgtagataatctgtcatcttataccaaaacggattattacggacagatgatgtatctttattcgcattacggtcaatattccggggaagattcccagcaaagtatactttattatgcccaggaaaagatataccgggattccattttttccagtataccggataatcatccctattatctatggtacagaggatggcagtataacggaactcctatggcagaagaggtaaaagaacagttgagattatcgctggcttctgcttcgttcgattccaggaaggaggctatgaatgcatatattttagcaataatgaatagagacgaaggtaacgaagaggaatatcttcgttacctcatcttatcagccatggctgatatccggtcggctaaccatgatatcgcatcattggaagaactgggaaaaacccttttagaaagaggtgccacagaccgcgcctattcttatctcaattattgcctcggatctgcacagttatacaaaaacagaatacgtatgatcggtatttcctctgcattggacgccatccataaaacctatgaacaaagaaataaaaaacaggaagccgatttacgccggtatctattcatcgtaagcacgttattattagttctgcttgcagccatattcttcatcggattacaaatgaaacggctgaaggagtcacgaaagaaactgaacaaagccaaccagagcctgaataaacgcgtcgaagaactggaacaggctcatgggcaactggccgaagtgaataatcagctccaatcattgaacgaacagttattggaaaccaacaataaactgacggaatcaaactatgtcaaagaagaatatatcggttatgtattcaatatatgttcaaactatatcagtaaactcgatgaatacaggaaaaatataaaccggaagatcaaaaccggaatgatagacgaagtgaaaaagatgacggatagttcttcaatggcttccaatgaactaaaagaattttaccgcaatttcgatgccatcttcctacatatctatccggattttgtttccgactttaatgcattgctcgaaccggataaacagatcatgcctaaagaaggagaattattaaacaccgaactacgtatctatgcattagtccgtctggggatcagcgacagtgtaaaaatagccgaattcctccattgctctgcccagacagtctataacaaccggctgaaaacacgtagcaaagcaatcgtacccaaagaacattttgcagaaattgtaaaatctttaggaaaaatagagcgctaaaatggacttgaaagcctccttaaccttataaaacaacttactttttattggtatataaaatttataaaaagctatggatcagcaatataataaatacattaatttacttctgctgtttaccagactattgaagcccacaaaccacactttacttttgcaaatacaataaaagtaaaaaacaattagtatgttaactttaaaatgtatttatcttatgaagaacattttatttaaacggaggtattatggaggtatcatccccatcctatgcctgttattattattcccgacacttgcattcgcccagaagttcacgatcagtggacaagtaaaagacacccagggcgaaccagtcatcggtgcaaatgttattataaaaggaacgaccaacggaaccattacagacctggatggtatgttctctattcctgacgttgagcaaagctccgtcctggaaatctctttcatcggttatacacctcaactggtaaaaatttctgacaacaaaccgttagtcataacactggcagaagacagtcaggcactggacgaaattgtcgttgtgggttatggtgttcagaaaaagagtgtggtaacagcggctatcagccgtgtaacagccgacgaactgaatgcagccaagccttcccgtgtggaagatgcgctgaaaggaaaagtttccggtgtacagatcacgcaaagttccggccagccgggatcagattctaaagtgcgtatccgtggtatcggaacggtcaataacagcgatccgttatatatcgtagacggtatgccggtagacggtggtatcaactacctgaacccggtagatatccagtctgttgaaattctgaaggatgccgcatcggcagctatttacggagcccgtgctgccaatggtgttgtacttgtaacgaccaagagcggaaaaagcggtaaagcgacgatcaactacgatttcagctacggatggcagaatccctggaaaaagaaagcagtcctgaacgcacgcgaatacatgactattatgaacgaagcacaggtgaacgacggaaaccctgctctttactcgcaggaagaaattgcttccgcaggtaacgggaccgactggcaggatgccactttcaactatgatgctccggttcagcaacatcaggtaagtattaacggcggtagcgacaaaatgcaatatttcctttctttaggctacttcaatcaggaaggtatcgtaggcggcgactatggtaaatcaaactacgaccgctggagccttcgttctaactctacctatgaagtgtttgaagcacaagatcgcaaattcctcaacaaactgaaggtaggtgtcaatatcggttattccagaggtacgaattccactgtcgaatcaaactcggaatacggttctatcctgggtagtgccatcacgttctctcccctggttcccgtttatgccaacgaaaaagaatcagctgagatcctggaaaaatacccgacagctgtcgtagacaaaaacggacgtgtattttctttgccgccttccggttatcaggaattggccaacccggttgcccagttgaatgctccttccgtaacaaaaaataatgaagacaagttcgtcggctctttctgggccgaactggatgtacttcccggactgaagttcaaaagcagctatggtgccgacctggcattctggggggccgacggatatggtttcgaatattatatgggctctatgaagaaaaacgaacagagctgggtacaaagcgaaatgaaccgtggctacagatggcaggtagaaaacgtattgacctacaataaaacattctttgaaaagaacaacctgacagtcgttttaggacagtctgcacaaagatactcagttcgcaaactgggtggtagcgactacgacttgcttgaaacagacccgaacaaggccaatatcaactctgctaccggcagccgcgacgacgaacgtacatggggtggcacggatggttacaactttaccgccctggcttcttatttcggccgtatcgattataactacgacgaacgttatatgttacaattcacaatgcgtcgcgacggttcttcccgcttcggaccgaatcataaatgggctacattcccggcattgtctgtcggttggaatgtgttgaacgaaccttatatgcgacaattccagagcgacgtattcaattctatgaaagtacgtttcagctggggtaagaacggtaacgagaatatcggtaacttccgttatacagccctgatggacggtggacaaaactactatttcggtggaggttacagcgtaaaggataacggtaaaaccggaacaatgcaatatggttcttcaccggcagctattgccaatcctaatatcaaatgggaagagtcggaacagatcgacctcggtttcgatgcccgcttcttcaataacggtttgaatttcggtttcgactatttcaagaagaaaacgaacggaatgttaatggataaaccgatcccaagctacgtaggacaaagcgccccgatgagcaatgccggaaaaatgcagaactggggacttgaattcgaactgggctggaagtcttctgtcaaagatttcaactattcaatcagcgccaacgcttcttacctgaaaaacaagctgatcgacctgggtaacgcttccggtctggctacttacgaaagtgccggtgcatccggagtaggtgaatatgtacgggctaccaacggggatgtatggccctacttctacggaatgaaaacggatggtatcttccagaattgggacgaagtaaatgcctatacgaacgataaaggcgaactcttacagccgaaggcacaacccggtgacgttcgcttcgtagatacgaataaagacggagtggtagatgataccgacagaacaaagatcggtaaagggatgcccgattggacattcggtttgacactgggcgcagactggaaaggattcgacctgaacctattcttccagggaactttcggaaacgatatattcgacttcgcacaacgtggcgatatcccggcaatgaaccgtccgacatggatactcgacagatggatgggtgaaggttcttccaactctatcccccgcatgacagctcaaaacccgaacggaaactggcgttcttccgacctgtatgtaaagaacggatcttatgtacgcctgaaaacagcccagctgggatataccctgcctactatatggactaagaaagcgtccatacaaagactaagggtatacgtatcggcagagaacctgttcacattcaccggttacgacggtttcgacccggaactggcctccggcaattatactacgatcggtgtggataaaggtatctatccgcaatcaagaacgatctctttaggagctaatatcactttctaacatttaaacgtatttatcattatgaaaagatataaattattcgcttttgcatctcttttggcggctgcagtcatgaccacttcctgtggcgacgatttcctgacagccgggccgacagaaaagccggaagccggtgcagccgcaaccgaaggaacgatcttgtccagtttgggttcggcttatcagatcctgatgtttgacagttatgcaaacaacaattataatgctgtgttacttatgtccgacctgcgttccgacgacttgttcaaagggggaggcgatgccggcgaccagcatcaattatatgtactgtcgcaattcagttccagtgcggcagaaactctcgacggattgtggagtatctattttaccggcctggcacgcgcgaacaatgcagttattgcctgtaagaatgcagtgaatgtgacggaagaaaaagtagcccagtatacggcagaatcccatttcctgcgtgcttactatacacatctgttatggaaattctggggaaatattccttacttcgaagctccgctggacgatccttacctggcacctcagatgagtgcagacgaaatataccagaaaataatggccgacctggaaatagcctgcggagaaggtatgccgatgaaagtcagcggagccaacctgggacgtgccaacagagctgccgccctgatgttgaaagcacgcgtagtgatgtatcagaaagatcagtctaaatatgccgaagtagccaacgatatggccacgatcatcaaaagcggcgattacgaactgatggatgatttcgatgccatgtggttggacgaaaatgaattctgcaaagaatccatctttgaaagcaaccagttgccggaaggtaaaacctgggatactggctggcagggatatggtacgaacttaccggcatttatctctccgaatgaactgaaagatcctgacggagtgttcaaaggaggctggggatttgctcctgtccgtttgtccgcttaccagatgtacgaagaaggcgacctgcgccgcgatgcctctatcaacgactggcgtcaaggcagttattcaaaacgtttccaggatacaggcctgttccaacgtaaatatgctgcccgcgaaggatacaaccctcctccaggcgaccaggatctgaattactgtaataacctgcgtattttccgttatgccgaaacactgttgaactatgtggaattggtgaagatgggaggtgctcccgaagctcagggcgtaagtgcagatgaatgcttcaaccagatacgccgccgcgccttcggtaccgataaaccgattgccgccacagcccagaatatcaaggatgaacgccataaagaattcctgggtgaaggaatgcgcttctgggatctggttcgctggggagatgctccgagtgtgctgacagaaaacaattccgagttcaactctgtccgcacctttgaagaatggatgaaatatcttcctattcctcagggagaaatgacaaagacgctgggaaccgaattcgaattgaaacaaaacggtaactggaaataaccgagtggctaacacgataaaacagacaataatatgataagaaatatattcaaatcaggaatcatcgtcctaatggccattttggcgatgacctcttgcgacccgcaagacaatgatgaccattcattaggtgcaatgcccgaagaaagccagttggctttctccgccacaccgaaaagtgaacaaccgaacgtgattgcactgaaaaatgaatcgagtataaaaggtgtcgtcacctgggatatgggagacggatcgaccgccaaaggagaaacggctgatgcgaaatatccgtttaaaggtacttatgtgatctcgatgaccatgtatactaccggaggatcggtaacgatcacaaaggaagtcacggttgcacaggacgatatgtccttattgaacactcctatgtacaacgccctgacaggaggtgccgaaaatctgcaaggtaaaacctgggtattcgaccaatatcatagcggacacttcggagtcggcccgagtaccgacgaagcgccttcatggtggtcgtgcccggccaacggcaaactggaatcgagcctttatacccaggagtttacatttatccaggtgggagtaaaaatgatctggaaaaacaatgggtatatctatacgaacgaagcgggtaaaaacgcattgggaggtacagccgttgttccccccgccggagactttgacgtaaagtatgaacctaaagatgcatatacttttacattgaatgaaacagctaagacgatcacactgaacaacggtgctttcttcggtcattatgcaggaacatccacttacgagatcctgagcctgacagacgacgaactgtatctgaaatgtaccagtaccgttgaaagcggtaatggttggtggtatcgtttcattccaaaagaaaagaacgtaaaacccgaagtggaaattaagcctgttacattggttgaagattttgagaaagataaattatccgtagaattcatccccgaaaagatgggagatatggaacctgtctattcgaatcccgcaccggtcggcattaatacgtctaaaaaggtatatctctaccagaaatcggaagagttctattccaacatatcatgggtatcggaagatactaagttcgacttgtcggaaaataacaagattcgtatgaaagtatatattccgtcttacaacgattatacgaccgctgctgccgttgcaggcgattggatcacagtcaataaactgcagaaacaggttgttgtcaaattgcagaataccgaagcaggcgataatgcatgggaaagccagactgagattgtaaaagcaaatctggagaccgataaatggatcgaactcgagtttgatttcagcacggtaaaagaccgtaccgattataacaaggttgttatccagttcggtgcagaaggtcacgccgccccgggaatcttcttcttcgatgatttctctttcaataaataagtaataaacaacagatagagagttggtaatacagcaactctctatctactcattcaaaacgggaagatgaaatattcaatcacataatgaccaccatgaaaacatacaaattaaatatcttctatgccggactgctggttctttccatgatggcatgtagccagccttccggagcagggaaaggagacactgttgaaaaacaggtagaagaactgctcggcaaaatgaccttacccgaaaagatcggtcagatgaaccagttgagcccgtttggcagcatggatgaaattgcaggccaggttcgtaaaggagaaatcggttcgttactgaatgtgacggaccctgaaaaagttaatgagatacagaaagtagcggtggaagaatcccggctgggtatccccctgttgatgtcgcgtgatgtcattcacggatataaaacaatattcccaatacccctgggacaagccgctaccttcaatccacagatcgtgcaggacggagcccgcgtagccgctatcgaagcatctgccgacggtatccgctggacgtttgccccgatgatcgatatctcacgcgatccccgctggggacgaatcgctgagagttgtggcgaagatccatatcttagctccgtcatgggtgtagctatggtgaaaggtttccagggcgactccctgaacgatccgacctcaatagccgcctgtgccaaacactttgtcggctacggagcagcagaaggaggacgcgattataattcgacattcatccccgaacgccaattgcgtaacgtctattttcctccgttcgaagcagcagcaaaagccggatgtgccacctttatgacgtctttcaacgataatgacggtgttccttcgacaggaaacagctttatcttgaaagatgtactgcgcgatgagtggaaatacgacggtatggtagttaccgactgggcttcgaccgctgaaatgatttcccacggcttctgtaaagacgaaaaggaagctgccctgaaatccgtaaatgccggaatcgatatggaaatggtcagcggcacctttatccgccacttggaagaactcgtaaaaaaggggcaaatatcggaagcggccattaataatgcagtacgcaacatccttcgtcttaagttccgtctgggactgttcgacaatccttatgtaaacacagaccaacatgtaaaatatgcacccgaacacctcgccaaagcaaaagaagcagtagaacaatcggttatcctgttaaagaacgatcgggagaccttacctttcaccgataagatccgtaccattgcggtcgtaggcccgttggcggatgcccctcacgatcagatggggacctgggtattcgacggagaaaaagcacatactcaaaccgtactggcagccttgaaagagatgtatggcgacaaggtacagtttatctacgaacccggattgggttacagccgcgacaagagcacaggcaatatttccaaagctgtaagtgctgccacacgtgcggatgccgtactggtatgcgtcggagaagagtctattctctcgggtgaggctcattctttggcagatttacacctgcaaggaatacagagcgaactgattgccgccctggcaaagacaggaaaacctctcgtaacaattatcatggcaggtcgtccgctaacgatcgagcaggaagtaaaccagtcggatgccgttctctacgctttccatccgggaactatgggtggtccggctattgccgacctgcttttcggtaaagtggcaccgagcggtaaaacgccggttaccttcccgaagatggtaggacaaatacctgtttactatgcccataacaacacaggtcgccccgcctcccgccaggaaacgctgatcgatgctattccgctggaagccggacagacttcactgggctgtacctctttctatatggatgccggtttcgatcccctgttccccttcggttacggattgtcgtacaccacattcggatacgacaacctgcaactggcaaccgataagctggctgccaacggaacactggaaatcagtttcgacctgactaacaccggtaaatatgacgggacagaagtggtacaattgtacgtacaggacacctttggctctgttacccgtccggtcaaagagttgaaaggtttccaacgcgtttccctgaagcagggtgaaaagaaaaccgtcaccttttctctcccggtcgaagaactggcattctggaacatagatatgcagaaagtagtagaaccgggcgaattcaatctctgggtcggccccaatagtgcagaaggattacaaacaacattcacagtagaataacagatatgaaaaagaatatatatttaatgatcctgcttctgctggtatccttcaccggatgccggcaggacgctgcaacagcaggtacggatacgaccgatatgcccccggaagcatttatgcgtatatccggtaccgacctggttactccaaaaggacagaagtttttcatccagggaaccaatctcgggaactggctgaaccccgaaggttatatgttcggcttcagcaaaacgaactcaccgggacgtatcaaccaaatgctttgtgaaatggtcggccccgactttacctccgagttctggaaggctttcaaagacaattacatcacccgcgacgacgtacggttcattgccgggacaggagccaacaccatccgtctacctttccattacaaactcttcaccgatgaagattatatgggactgacttccaaccaggatggattcgcccgcatagacagtgtggtcaactggtgccgggagaccgggttatacctgatcctcgatatgcacgatgcaccgggcggacagactggcgataacatcgacgacagctacggttatccctggctctttgaaagcgaagccagccagcaacagttctgcgatatctggaagaaaatcgcaacgtattacaagaatgaacccgtaatcctgggctacgaattgattaatgaacctatcgccccctatttcaataatatggaagaactgaacgccaagctggaaccgttatacaaacgggctacaaccgctatccgtgaagtggataccaaccatatcatcctgttgggcggtgcccagtggaacggcaatttccgtccgttcaccgattccacctttgacgataaaatcatgtatacctgccaccgttacggcggcgaagccacaaaggccgctatccaggaaatcatcgacttccgcgaccgtgtgaacctgcctatgtacatgggagagatcggacataacacgacagcctggcaaaatgctttctgccacgtcatgcaggaaaacaatatcggctggactttctggccttataaaaaaatcgacgaatcatctttcgccggtattaaagctcctgagaactgggatcgtatcgttgctttctcagaagctccccgggctacttatcaggagatacgcgaagctcgtccggatcaggaagaggcaaaagcggctctgatggaatttatagagaacagccggttacaaaactgtatcattcagaaagaatacatccgctcactaagtttaaaagcacaataaaacgacatgaaactgattaagtatattgcctgctccctgttgttacttcctgcatttgcccaggcacaacaaagcattccggtttacctggataacaataaaccgatagaagaacgtgtggaagacgccttatcgcgcctgacactcgaagagaaagtggcattgacacacgcgcaatccaagttttgttctccgggggtggcacgtttgggtattcccgaattctggatgaccgacggccctcatggcattcgtcccgaagttttatgggacgaatgggaacaagccggatggaccaacgactcttgtgtagccttcccggcactgacctgcctggctgctacctggaatccgaaaatagctttattgtatggaaagagtatcggggaagaagcccgctaccgtaacaaaacggtgctgctgggccccggtgtgaacatgtatcgctcaccattgaacggacgtaacttcgaatatatgggcgaagacccttatctggccggaaagatggtggttccctatgtacagggcgttcaacagaatggtgtggcagcctgtgtaaaacattatgcactgaataaccaggaagtaaaccgtcatacgaccaacgttattgtagacgaccgtgccctgtatgagatctatttacccgctttcaaagccgctgttctggaagggaaagcctgggcaatcatgggttcttacaacctatacaaagaccagcacggttgccataaccagtatctgttgaatgacatcctgaaaggtgaatggggtttcgacggcgttgtcgtttccgactggggaggcgttcataatacacaacaagccataaccaacgggctcgatatggagttcggaagctggaccaacggattatccaacggggcaagtaacgcttacgataattattacctggcagatccctatcttcagttgatccgggaaggtaaagtcggcacaaaagaactcgacgacaaggtaagacgtatccttcgcctggcttatcgcacgaatatggatagaaaccgtccttacgggtcactttgctcagaagcacattttgccgctgcccgtcaaatcggtgaagagggtatcgtcttattgcagaacaagaataatgtacttcctatcgacctgaaccgcgcaaagaaaatagccgttatcggtgaaaatgccgtcaagatgatgaccgtaggcggtggttcttcttccctgaaagtgaaatacgaactctctccgctggatggtatccgcaagcgagtaggtgataaagccgaagtcgtttatgcacgtggttatgtaggcgacccgagtggtgaatacaatggagtgaagtccggacaggatctggaagacaaccgttcgccggaggaattaatagccgaagccgtggctgtagccagggaagccgactatgtgatctttatcggcggtctgaacaagagtgcacatcaggactgcgaggatgcagaccgcaaggaattgggtttatcttacggacaggatcaggtaatagctgccctggctcaggcgaacaaaaatctgatcatggttaatatttcagggaatgccatcgccatgccgtgggtgaaagaagtaccggccatcgtacaggcgtggtatctgggctcggaagcgggaaatgctattgcttcgatattgctgggagatgtaaatccatccggtaagctgccgttcactttccccgtctctttacaggatgtaggtgcacaccagttgggtgaatatccgggcactcccagaaacgacggtagcaacctggtagacgagaagtacaacgaaagtatcttcattggctaccgttgggcagacaaacagaaaaccaaaccgcttttcagcttcggccacggcttgagttacacgacattcgaatacggaaaagtaacagccgataagaagacgatcgcaaaagacgaacctatcactttcaccctgaccgtaaaaaatacaggtgaccgcgaaggggcagaaatcgtacagctttatatcagcgacaagaaatcatcgctcccccgccctgtcaaggagctgaaaggtttccaaaaggtttacctgcagccgggagaagtaaaacaagtatctttcaccatcggtacggatgcactgagtttcttcgacgacggtaagcacgaatgggtagccgaaccgggacagttcgaagcattgatcggcgcatcggcaaccgacatccgcagcaaaatggcatttgaattgaaataaccaatcccccttttctatattttgtccggatatattgcttaacggcacatatccggactattttatatgtatccttatcggatcactccggtttcattcgcctcagatattcagaaggcagaacaccgaattcttctttaaagcactggcggaaataaacaatgctgttgaaaccgaccataaaggcgacctcagaaacattatatttcccttcaagcaataaacgttcggcatattgcatcttcacctttcggatatattcgttggtagaaagtcccgtcagtgctttcatcttccggtaaagcgtagagtggctcatgcacatcttatcagccaggtaaccgatatcgatcttttcagacgacatacgctcttcgaccagctgattgatctttttcaggaactcattatccagcttgttcaacgactcttcgataatagcacgtttatcaccgacaccggagattgaactgaatcgttcggccagctttttacgtgtatcgagcaggttctgaatacgactatgaagcaatgtagcactaaacggtttcgtcaggtacgaatcggcacctatcaggtatccttcctctttatcctgcaatgaatcttttgctgtcagcaaaacgacagggatatggctggtacggagatcttccttcaatgttttacacatatccatcccgttcatcaccggcatcataatatcgctgacgataatatccggtatatagttgaatgcctgttccaaccccttttccccattctctgccgttttaacatcgaaagtatcagagaatgaatcgacaatataatcgcatatatcctgattatcttccacgaccaataaaatacgctttccgctacccgaaggctcgggaagaacctcctgtatttcatcctctttcgttttcttcttttcattcgaatcggcatgaagaacatgcggatatgtgttatcggtcaataagctgatatagaaaatacttcctacattcaacgcgctttccacccggatatcgccttcatgaagtaaaaccagattttttaccaatgccaggccgatacccgtccccgaagcctggtgtccgcttccttcctgataataacgatcaaagatgtgcggaagcgcttccgcactgataccgtaaccggtatcgctcacctttatttctgtcttggcaagcccgtcgcgcatgacattgtaaagactcagggtgataacacctttatccgtatatttgaccgcattcgagatcaggttgtcgaggacgatcgtaatcacctccttatcgaagaacaggggcatatcctccttctccaactcgatatggaactctatgccgggttttcggttcagttccttgtatttcaggccgatctcatagatcagagctgctatattcccacggctgacacagagcttcttgttctgcgtctccgtcttccggaattcaagtatctggttgatcaggttcaacaggcggatcgcactctggtggatcacggatatcttttgcgaatcgccggaagagagcgtgttacgcttcaacaaatcttccagcggccctaatatcagggtaagcggtgtccggagttcgtgggtgatgttcgtatagaaacgaagacgttcgttattcagttcctgttcctgttcatgtttctttttttccaggttatacaaagactccatttccaccttccgcttataggcataagagatcagaagtaaagtgagaagtgccagaaggagataaaaagttttcgcccaccaggtaagagccaacggaggagtaatacatatatccagccccgtgatatcttccgaccattcctggttccttatacgcgttttgaccagaaaacggtaatcgccgggaggtatattacgaaaagtcacgttattgggatcggtaacggtataccaggcatcttcgagccctttcaacatataggcatattctacctgattgactaatgcgtaattccgtatattgaaggtgatattgaaactgttctgcatatagctcagtttcaccttcgattgtctgtcgataggaacttcctgctcactgctaccggtatttcccagcggaccgaatattttcatttccgtaataacggcggccggagcttcccgtttctccaacaccaaagccgggttgaaatggcataatccgttgatagaaccgaaatagatctccccaccctggtctttcgctacactcccgctcataaagttacccataggcacatcgtcccaatggtcatagttattgaagacgacctgatctttcaggaggcaactgatacctttgttggtactcagccagatattacccatgttatcttccgttatggcacgtatatgcgtattcatcaacccttcttcccggcgataaaccttataatcccaaccggatgacggggagaaacagaccagaccttcccccgttccgacccatacgttctgccggctatcttcgtaaatggcattgatcgtattggaagggaagagattttctatactgaatgctttgaagttttgcaaatcgccatcgcttactcccagtccaccgccaaaggaaccgacccacaagcgtccgcgggagtctttcagcaggcttcttatcagattgttttcaaaggaatagtgtccttctatctttttatcggcaagatcgatcttataaaagccgttactggtaccgatccataacatgcggtcgtcatcctcatagaaagcacgcacatcctctttggcgatttcaggaaggatgttgcgacgaaaagcctttgccttcgcatcataatagttcactccgctattaaacattccgaaccacagattaccctccgaatcacgcagggctgccaatacggaattgccgaacgtatcgttggtctcttcctggtaaagggctacccgcgttcctttatcaaagacgttgattccaccaccatcggttccgatccacaacttaccctgaccgtccacacaaacgctactagccgttttattattcaggcgactcacagaactctggtctgccgaatagtaatatcctccgaactgcggcgattcgtaactcaggaaattgataccgcctccccacacacctgtccacacgtttttgaacgaatcctgaaagatacatctcacactcgaattggacaaactataaccgtcgtccccttcgcagatataatggaaccgggactgttcgggcaactgaaacaggcgttgcgtcaaatccataacggcaattccgccaaactccatggcaatccataacttatttccatcgagttgccggatatcatagacataatgcaaaaggttcttatccgaattaaaagggataaagttctccgactccgggttatacaaggctatacctctgttggttccgacccagatattattattcaaatccttgtagacacaccgtacttcattacccggcaagctgttcggatccgctggatcgtgcataaaattctttaccctcttttctctgacagaaaagacactgaagccatggtgcacatgcccgatatataatttcccgtttcctccgtccgctaccgaccagatgttatcactgaccaactccggtacggtttctttattataatgggtgaaatgaccggttgccttatccaggtaatcgatacctttccaataagtcgcaatccagagattaccgtcggatgcagcagcgatatgggttacgtcgtccgtaataagactttccgggatcgtatcgctatgccggtagatggtaaaagtatcattcgcataatcataggcattcaacccggttcgctgcgttcctatccacaggacagaatcttccgggtcgtcgagcaggtggttcagttcattccccgtaatgccgtacccatcttccgtttcgtttttataataagtgatgaagcgtgtcccgtcgaacttattcaggccttcttccgtggcaaaccacaaaaagccttctttatcctgggcaatactgaccacatagttgttggataatccttttccgatacctagttgtctgactgcataaggttgtgccgacaaaaggacaggaaatagtagaagataaagtaaaaatcggattctcatggcattcgttttctattccaattcaaacatacaaagaaaatccgtaattaagatacacgaatcgttcattgcaagatttgtgcctcctgattgcacgatttacccatacttatagaaaataagatcacttatctttgtattaagttaaaaatgtaaacaatacatttctaagagtataaagtaatcaattagtttaactttaaaaacaatatttatgaagacgcatctatttaatgccctgttactttgggcatttacatcgttggctttatggacaacaggatgtagcgaggacgacggctatcctgacgtagacggacagagccccgctctgaccttaacaagtgaccatattcagaccgcagccggacgaagcttcacaatcaagggaacagtcagcgacaaagatggtatcgccgccatcaagctcgaatgctccgatctcaatctcaacaagacgatcgatctgatcgaaatctatgagaaacctctcgaaacatacgaccttagttatagctttgctatccagaaagaggagatcggtgaacagttcaccgtcaaagttactattatagatgtaggcggacggtccgtatcacaagatgtgttggtaacgatggacggcgacttcgagaacccgacatttacggtatctcccgatgcgagcgtcaccgtacttatcaaagcagaaaccaaattcaacctgcgtttctctgtcaaggacgaccgggcattggattgcgtaacggtagaaatcccgggtatcgacggttattccccccgcaagttggaggttaatggtgaaaagacattcgaattctctgagaaaatcgcattaccaagcattatacaggattataatgtaacgatcacagctgccgacaacgttggaaatacatccgttataaagagcgttatttccgtatccgaattacaggacttcgaaaagatgtatctggccgatgtagcaacggttgaagaactaaacagcgatgtattcggtgtacctatgcgtatcgaacataccggcgcttacgaatataaagcgaattattacagccagaaggctaacaccgagatcttcttcctgccgcaaaagagcgacttcgccccgatctgcttcggcctggacccggaagacaataacaagctgacggacgatcccgaaacggccaaaccgatcgttctggaacaggcgaacgtttattacgaaatcacactcaatacgatggaaggcacttatgccatacgtagttattccattccggaagctatcgacccgctacctcatgcacaaggttcgatgcttctcgaccagtggggcgacggcagcacgcttaccgaattctatatcggttataccaccaccggcccatccgccgtacaacgttttacacaggatgctaccaacccgcacctcttctatctggaagataatctggaactgaccggaggtgaatcgatgaacttcatcatccacaactatcactccgacggctggtggaactactgcacatggcgtaccgacaattcggcagaacccgaaacgttcgattactatggcagtataaaaaacccggcatggacaatacctaatacgacacaggacaactgggctaaaccggccgtaaatgtgacaggttcgtataagttctacttcgatgcacatttgggaagagctaaattagtccgagtaaattaatctataatattgaaactggttatgagaaagcaattattaataacatgtctgttactgttggcattatgtggttatgcacaacagataacagtcaaaggaatagtaacttccgctaccgacagcgaaccgctgatcggagctacgatacagatcaaaggtgccggtagcgggactataacgggtatcgacggtgattatacattggcaaatgtcaacccgaatgcgacacttatattctcatccataggttatgagacccaggaggtccgcgtcaacgggcaaccgacagtcaatgttgtcatgaaggaagcgagcgagttgctcgacgaggtagtagtgatcggttatggtgccgtgaaaagaagtgacctgacaagttccatttctactgtgaaaggggaacagatcacggaaatgactaccggtaatgcgatggatgccctccaggggaaagtgaacggcgtgcaggtcaccagtggtggtggcccgggcacccagcccaaggtattgatccgtggtgtgacgacagtcaacggtagcgacccgttgtatgtagtagacggaatgcctgtcggtacaaacatcaacttcctgaacagcaacgatatcgaatcgatggaagtattgaaggatgcttctgcggctgccatctacggtacacgtggctccaacggtgttatcctgatcacgaccaagaaagggtctgccggaaagacacgcttcaacttcagcacttcagtcggtttccagacaattgctaacccgaatatggctaaagcttcggaatacgaacaggtattcaaagcccgttataccaacgacggacgtactccgatatggaacagtaaagacggtatcaccgatgccgaaggtaccgattggtgggatcaggtcgtgaacaagactgcgctcgtacagaactattcattcggcctttcgggtggtaatgaaaaactggtctataacctgagcctgggatatttccgcaataactcccaatatgatgtaggttactgggataagatcaatgcccgcctgaacacggaatacacattcaacaaatacgtgaaaatgggattcgatatggccccgcgcgtagaatcgtgggacgatacccccaaccagttcggagcagctatgtcgatggacccgacaacttctgttttcaagccggagtcggaatgggtcgacaatatgtacagcaactacgcacgttccaacaacaacgagacagtgaaccccgccggtgcaatctcacgccagaatgcacattcccgcgagtacggattcatcgtgaacccttacttacagatcacaccaatgaaaggcctgactttacgtacccagttcggtgccaatgcacatatccgccgttcggactcattcacaccgaagtactatatccattcgcaggaaaaatcagatttgagtaatgtatcccgcgaaatgcaggaatggctcgactggaactggacaaacacggctaactatatgactaccatcgctcagaagcataacctgaatgcgatggtcggattcacggcagaacgtttcgccgcctatcagatgaaagcgggtcgcgacgaagtacctaacaactcggacaacttacaggaagtaaatgccggtaccatcgtaaagactgccgagggtaaaacctcctacaatacgctgatctcctatctgggacgtctaatgtacaactacgacagccgttattacctgacagcatccgtacgtgcggacggttcttccaagttccccacaggaaacaaatatgccgtattcccttccgtatcagccgcctggcgtgtgatcggcgaagagttcatggcagaccagaagatattcaacaacctgaaactccgcggaggctggggtcgtgtaggtaaccagaatatcgacaactccgcttatctgaccctgctaaatgcagccgactatgtgttcggttcgaatgccgatcgtgtgagcggtacttccgtctcctccgtaggtaacaatacactgaaatgggaaacagtagaagactggaacgtaggtgtcgatatgtctttcctcgattcacgcctggacgcaacattcgatatctaccagaagaaatcgacagacatgctttataagaaacagaacatttacgccgtgggatatcccgattggaacagccaggtgtggatgaatatcggtagcatgaaggctaacggttgggaattgagcctcaactggcgcgataaagtaggagaattctcatacaacgctggtatcaacttatcgtctgtaaagaataaagcaatcaagttctccggtgacggtgccgtccttaccggtgctttcaaccaggatcagatcatccgcaatgaagacggcggcgaaatctcccgcttctacggttatgtggcagacggactgttccagaactgggatgaagtatatgcccacaccgacgaacatggaacactgatacaggcaaatgcacagcccggcgatatccgcttcaaggatatgaaccacgacggcatactggatgaaaacgacaagacctggatcggtaacccttatcccgacctgttactcggattcaatatcggattcaactacaagaacttcgactttgccgccaacttctacggaacatttggcaacgatatctataatacgaccaaagggctgtatgccggaaccagcggctcgaacgtatacgccggaacatttggcaaggtttggagcggtgaaggttccagtaatgatatcccgcgcttgtcggtaaacgatacgaacctgaactacacacgtgtatccagtttctatgtggaagacggttcttacatgcgttgtaaactgcttcagctaggttatactattccaaagcatttgctgaagggcatggacctgcgcgtttcattctctgctcagaatccgttcacgatcaccggttattcgggtatggacccggaacgtcctcagatcggtaaagacggtagtgtgatcgagaccggtatcgacaacatcgcttacccgaacccacgtacattcttattcggtattgactttaaattttaatccttttagaacatgaaaaagataatatatataatcgcattgatcacctcggtgacatttgccggatgctccgatttcctgaaagaagatgtaaggggacaagagaacctcgatacctatttccaaacggaggaagaagccgaatcattccttaccggttgttacagtgccctgacttatggcggctggtggcagatcaacaaactatggctgttgtcggaaatgtgcagcgacgactgctggatgggaaacacggcacaagaccagggggactatatctccgtagcacattatcagggtaacggacaatcgaacgaagcgatcgccaacttctggcaataccgctacaaaggtattctgcgctgcaacattggcatcgaaagaatccccgaagcttctatcctggataaagagaaacaaaatagactggtagccgaagcccggttcctgcgtgctttctattacttcgaactggttaaaaactttggagacatacctctggttaccggttttgtcatgccggaagaggtagaaggtattacccgcagtgaagcaagcgctatttataagtttattgaagacgacctcgtggctgcttccgaagtgttgccgcaacgtagcggatatgccgacacggaactgggacgtgctacccgtggcgctgccctgggacttttgggaaaggtctatttgtatcaggataagtggcaggaagcccgcgatgctttcaaaacggttatcgacgaaggagaatacgacctgcttgccgacttcggcgatgtatggtcgatagaccacaacaacagcaaagaatcattgtttgaagtacaattcatgtacagtgaaacatacgctttgggtggttccctgtctgttattaccggtatgcgcaactcgagtgacccggatgacggttgggcatggtgccaaccgacaagcgacctcgaaaacgcttatatcaaagcaggtgacgacgaacgcctgaaatggacgatcatcaagaccggttgtaccgaaatagccggagaagacaacttcgacgtattcgctgagaactccaggaagatgggtagctacgatacgtatatcaaaaaatacggctgggatgagaattgctgcatcgtcgatccggagaaacataaatctgcccgtatcaaccggaaattctttgtaccttatgccaaacgtccggctaactacaatacggacaaggttcctttgaaccaccgaatcttacgctatgccgatgtattattgatgtatgccgaagcctgcaacgagcttggcgatgacgtaacggcaagaacaagcctcaacaaagttcgcagccgtgttcacctgccgaatgtaacggtcagtggcaacgatctgcgtaaggctatacgcacggaacgccgtttggaactggcactggaaaacaaccgtttgtatgatatccgccgttggaacgacgacaacggaaagaagacgatttgtaacctgatgggacagaacggttcgttcgtcctgtataatacaggatcaaatactgacatctacgaatcggaaaatcagggtgaacccagcaacaaaggtatctcattcaatgaaacccgcgatctgctgttcccgatcccactatatgagataaccatgtccggtggttccatcacacagaacccaggctggaattaagtatcagcagttcaggacactagtgtcagacccgatagcactactgtgctatcgggtctgacacaatagtgctattaacaccgaaaatatcaaccatgatgacattcaaatatatcctctgtttaccattaatagctactctcctggcttgcagcgacgacggtccggacactcctgcccccggtaccgacgaaccgggcacaagcgtagagaaatccgtatccatcaatgccgggcagacctttcagaccctggcgggattcggtgcatccgattgctggatgcctgcctatgtgggtaaatactggacttccggccgcgacaagatcagcgaattgcttttctcttccgaaatacaatccggcaatcccaaaggcatcggcctctccatgtggcgtgtgaacctgggaggcggaagtgccggacaaggcgatgacagcggcatcgaagacaaatcccgccgtgccgaatcgtacctgacggatgatctttcattcgactggacacgctgcgagggacagcgttatttcatgaaccgtgccaaagagttcggctgcgaaagtatggttcttttcagcaatacacctcccgtacagtacacctacaacggcaaaggcttctccaaccgcggagggacttcgaacctgaagggtgaacactacaccgattttgcggcttatatggccgatgttgcccggcattacctgaacgaaggatatcccgtaacacatatctcgccggtcaacgaaccgcagtacaactgggaaagcggccaggaaggaagcggctggacgaacgacgaaatcgcccggctggcacgcgaactcgacaaggaactgacacaacgtaatctgtcgaccgaaatactgctcggcgaatccggcgactgggaatacctgtataaaatcaagaacgacaacaaccgaagcaacgttctctccgccttctttaccgccggttcttccgcctatgtgggtgatctggaacatgtaaagaaacggatctgcggccatagctactggaccgacggtacctgggacgacatgcgcaacgttcgcgcacaagttgcacaggcggcacaaaaacaggacatcgacgtatggcaaagcgaatggagcatgctgggcgacggatacagttcatccgaatttgccggatatgacgcagcgaccaaaatggatatcgccctctatatgtccaaagtgatacataacgaccttaccgtggcaggggtatcttcctggagttactggacctcgatggatatgccccgctggggacacaagaaccgctttctactgattgcattgactcccgtaggaggggtcgaaggtgatgtagaacaggaaggctcctaccaggccacccctacgctttgggtactcggtaattacagccgtttcatacgtccgggataccgcaggatatcgttggaactgaatgagtcacacagcttcttcggttcggcatggatatcacccgaaagtgacaagatcgttgccgtctacaccaacctgtcggaaaaaggtgtccgcctgaatgaaacccatacaggctggaacaatgaggtaaaggaagttacgacctataccaccaccgccaataaaaatctgaaggaaagtaccgtgactaatagtcagcaggtgattttggatgcagaaagtgtgactacagttgtgtataatcttaaataattgtttgatatgaagaatgttctatttgtagccattatctccgtaatggctttctttacaaccgtcccggcagacgcacaggtttcatttggcgaccctctgaaattcaacgatggatggttattccgcctgcaggatgattctactgccgtcggaacagattacaatgacagtgaatggcgaaaactctctctaccacacgactggtctgtcgaaggccagctatccccatcactcgccagctgcaccggttatttgcccggcgggatagggtggtatcgcaagcatttcaatattacggacaaggcagcccgtcattatatttatttcgaaggggtatataaccgtagcgaagtctatctgaacggtcacctgctcggcaaacgcccgaacggctatatctccttcctttacgacatgaccccttacctgaaagagggcgagaacgtattgagcgtacgggtagaccacagccgctatgccgattcccgctggtacaccggctcgggcatataccgtgacgtatggctggtctccgctcctgaaatacattttgcccaatggggtatcggctggcatgccacctccctgaccgaccgacaggctaccgtagccgtcgatatggaagtggaaaaaaacagagcgacaagtgataaactcgaagtttcagccaccttatacgatgctgacggcaaacaagtggcacaacgccgcacccgtgtttccaacggaaaagaaggtatcaccaaagaaacgctcacactgaaagttgcaaaacctacccgctgggatctcgaccatccgtatctctatatactggaaaccgaattgctctgcaacggaaaacgtatagacaactgcaaaaccaatgtcgggcttcgtacactgaacttcgaccccaataaggggtttgccctcaacggtaaccggatgaaggtaaaaggcgtctgcctgcaccatgatgcaggtgtactgggtgccgttgtccctcccgaagtatggcaacgccgcctgactaacctcaaagagatcggtgtgaatgctatccgcatgagccataacccacaggcacctatcgtttatgacctgtgcgacaaactgggtctgctcgtcatggacgaagcgtcggatgaatgggaattcccgaaacgtaaatggatcgaaggatggaataaaggagaaccgggttatgacggtacgtacgatttctttgaggaatggatcgaacaggatgtcacggatatggtccgccgcgaccgcaaccatccgtctatctttctgtggagtatcggtaatgaagtggattatccgaacgatccttactcccatcctatcctcgacggctcgacgatcaaccagccgatgttcggcggttacaaaccggatgccccagatgccatgcgcatcggcgttattgcccaacgtctggccgcacgtgtccgtgccgtcgacacttcccgccccgtgaccggagcactggctggtgtaatcatgtcaaaccagacagcttatcccgatgccatcgatgtagtaggatacaactatacggaagaccgttacgacgaagatcatgccacctatcccgaccgcgtcatctacggcagcgaaaacggctccggactagaagcctggtatgccgtcaagaacaaagagtttatcttcggacaattcatctggacaggaacggattacctgggtgagtcaggcgcatggccttcccgcggactgaataccggactgcttaatttcggaagtttcaagaaacctcgcggacatttccgtgcttcgttatggagtgaaaaaccggtgacatatattggcacttatcctaaacggggatatctgtcggcagatgcaccggatatctggaactacgatccgggacaggagatacgggtagtctgctataccaacgccccgcaagcacgtttgttactcgatggaaaagtagtaggtgacataaaaccttacgacgaaaagacaggaatcatccattgggatattccttaccaggcaggcgaactacgcgcggaaggttgcgacaaagaaggaaatgtactttccagttacgtgatccggtcatccggtcgtccgtatgctcttcgtgtcagtgcagatcgcacaacgctctcccacgaccgggctacggcacatctctttattgaagttgtcgacgaaaacggaacgatcgtgaaactgggtgacaacgagatcacctgcgagattgaaggagcggcacgtctcctgggactcgaaggttccagcaataccgacatgaccgattacaccgacaatcgccatcgtatttaccagggccgtctgctggcgtatgtacagaccacaggagaaaaaggacaggcacgtgtgaagtttacttcaccgctgttacaagggactgagatagtactgaatgtagagtagagaacactttaaagatataagggagacagaatctaatatccaatgataggtcttaggattctgcctcccttaatacatattatcattattcagcgacaaaagtatacacatttccaccgaaatcgacagcaatcagtgcgttgccagaaacagccaccgagccgaataccggagcacctgtcgcatgtttccacaccagtttaccgtcttctttattcactccgtagatagttccgtcggaagcgcctacataaaccgtattacctgccagaaccggactggtttcgatcgttgcggaaggtttacgagaataaggggaagtgaataccaaagcgtcgttggttgcaaacttccatttcaactccagtgtctcgttatccagagcgatcaaaccgtctttagctgaaccgaagatgatctctttatccgtcagcaaaggtgtagaagtcacatccacactgaaaggtaattccttgcgcacaatcacgcgccccgtattggcatccagaataaagaacgattcactcgaaatgatatacagcaggtcaccatggacagctgccgaggcaccacggttacgcaggccgttcgtattggcttcccatttcagttctccggttttcaggtcgtttccgtaaagtgcacgccattgggaagaaccgaccaatacattctttgttatagagaatgtcgttgttgttccttcgccctgcccccaggctttattccgccaaatttcacgaccgtctttcgtatcgatagcacaaagccctttacctgtacctgcataaacaacaccgtcggaagcaaccagcccttcgatcagggaaggcagaccgtttatcggtaactgtttttcccagctgagtttaccactttcggcatgaatggcatataaatacccctgtgcatcttgtgccagaacctggccgttatctataacgatcgtattcttaacagagttgcgtaccggatatttccagataagttcgccggtcttaccgtcgagagcatatacatgggcctcccctttcagatcctcatctacagaagcgatatagatctttccgttataaaccaaaggcgatgtcatataaatattcgctcctacattctttatccaggccatctgtaaaggctggttcagtgcaggttgagcaggtacggcatgctgaggattctccagcaggtttacccagttaccgcccagtttcacctccacaggagcagcatgatatgtaaaggcactttcagtttcagctgtttctccgttattgaaacgggcttttatctttaaagtaacagcctttccctcctgtttggcagtcaaaggaacttcggcattccaacaccagtcggtagcttcttgcagttttttgttactgaacaaggccttaccatctaccagacaggtataggtcacctcttttaccggtgtaacggatgaatagacatttaccgccaaaggtacggcacccgaagccaatacaggtacctgtccctcaaccggggaggttatccgaatctgtttatccagataagtataacgaagctcggaaacgaaatctcctttcttatcgacatgaaggacacggaaagcactggtcgagtgatcgataccacctttatctaacgttgccgtagaaatagaatatacatctccctgcttcttcatataattgatatgccagtggccgtatacccaagccttcaggttatgttcattcaggttgatctgctcctggtcgttgattccgaaaataaactggtcgccatacgtcaacaggtcatggttgaaaacgacgatcggcttaccttgcggaacctgtgccagatcatttttcagccagcgatagacatcttctttcgtataaccgggttggtagtcaccaccggccatcggagtcacgatatagtgtgtactacctgcatcgaatgaataatagacaggaccgtagatactttcaaaaagctcttcaccatattttcccttcaccaggtcatggttaccgatagcataaaacatcgggcaatccatattggcggtattcatcattttgatatgtgccttcaagcctttttcatagcagatatcgcctgtgtgcataataaaagcgacctgttcattggctgcataatcacgcacattatttacccagtcgccatgattctccgtattgaagatctcggtatcagcgatatggacatatttatggctaccgtctttcttgataccgccgctataaggctgcaaaccgaactcatacgctttctgttcgccgtcgatacggatataatgtttgttatccgtcttatatcctgaaggagtggtgataaagataaaccgttcacgaggatgtcccggtaaagaaaaagaaccgtcggaagccgttttcacgacactcagcccgtcggagacagcaacaccagccatcggtttctctcccttatcaaaaactccgttattgttcttatctacaaagacccgtccagtataggcagcactggcagagaatgccacacagctcaacagggcaatgttcagaaatgtttttttcatgtgattgacttgtttatatttagaatgttagttgtaaatcttctatccagggcactaaaggttgcgaccggtcggtaatacccagttcttcgggacccggagcaatgaactcgctctttactcccttcagatccatacctttatctgtcaacgtaacgatcccgtaaagggcatctttataaggcagcgtatatttcaaagccggtctcttctgattgatctcatcgctgaaacgttccggacaggcatatttctcgcctacccattgattggaagcactgttgatctggatataggctatgccgttgatctctttcatataattcgtatggtcgtgcccgctgaaagcgactgctacctttttatatccggcgcgttgattttcctcttcaaagattttccggatatcttcacggttctctgaagaacactcaaagctttgatgggagaagatgatacaacgtttgtcggtagccttcaggtctttcttcagccattccatttgttctggatctaccaatgagatcttttccgctttataatagtttcctttatcgtatgggagatagttttctccgtcatatatattgttcggatcgagtacgataaaatgaaaatctcccttatcgaaggaataataggggttctgcatccccgtaaactggataaattcttctttcgaacaattatccatatcatgatttccaaataccatatgtttttcaccggcataatcctgccacagtttcaggaaaggtttgttttcttctttcggcatacagaagtcaccgagttcgatgataaagtcaacctgactttcctctgcaacccgtaagaaagtacttaaacgttcttccgcatcatgcgcaatgtcctgatgaatatcagatatgatagcaaatgttacaggcttcgtctctttctggcaggaactgaatcccagacagataagcagggataagaataagtgtttcatcatgattatttcttaattttaaaagttgtcaaaacaaatccgtgatcggaagcatagaagaaatcgtctcctttaaaagagaacgttttacccagaatattatcatagcattgagactctaccgcctgtatcgtctttccctgataatagatgaagtcgatacgatcctgccggttcactgtttccaaagaatcagcatctgtcagccaggttgttccgatgttcttcaccgggtcaggattgatctcgcggaaactgtctttgaaattggctgcctccatctctttggagaccgtccagttgaccacagcacctccatgattgtacatgtctttagtcgcttccgtccagtccaggtgagaatgactgttgaaatcgcctcccataatgacaggaatactatcagtctcagcaatcacaggtttcagaacccccaatattttacgtatctcgtcgttgcgtgttcctgcatcgtcccatgccagtatttcttcttccgacttatcggtaggaaccaaacgtgcatcaggtaaataatggatccaagtatcgaacaaacgaaccggcgtcccatccatatctatctccactcctccaaaattgaaagtatcgatcacatcgggataagaatatttttttacgatcggataacgactaaagatacaaagattactagatatcagataatgttcgtaaccgagcgaatctgcaatcatcggtgctgccccatacgtctcaaccattaggataacatctgcctggcttttcttcaacacgccgatgatgccatcacaagctttttgtccataagcttttgagtgacctgcatgccagatattccaggaaaggacagtgagttgttgttctttttcctgttcggagcaagaagataatagacttagaagtagtattacagatgtaatgctgataagaatttgtgctttcatgtatataacttatcgatattaagataattcaaccacaaagatagaaagataaaagtgattcaaaaatatatcccaaaagtctgtatccgttacaatgtcggatacagcttttgagatataagaataatttgttttacctacaagtaaaagcgtgatgaattattgcttccaatattggttctgaaccagattcggattataaatcaagtcctctgttgcaatcggagtatagtaatatttaggttctataaaattccaacggccaacctgtgaaatcatacggacatatcccttattcccattggtcagcgaataagtattgccttccaatatttcaacttgcagattgtatttatccttatcttcctgcggaatagcatctgcatcagcctttgtagcaacaatcgcataatccggttgtccatcgccggttacatccaaatagccaggttccagataaacgccttccggcacgttagccagcagtttaccacacccccaacgtcttaaatcaccatagcggaaaccttcacatgccagctcaatacggcgttcgcgacgtatttcataaacagcacccttttgtgaagaagcgacattcgcataacggttggcctgtaccggatcgatgttactcagccagtcgaccaacgaagcacgcggcatacctacacggtcacgcaacagattgattgtccgatccacgtcgtcctgtgtcaactcacccaattcagctttcgcttcggcatacatcaacaagacttcggcataacggatcagagggaggtctgtataagaattactccaagtaatttgatcagccgtgcgaggtgagaacttcacctgcggataaccacccatcgtcagtttcggacgatatgcatctactttgtctgcccgaacaaaacccggtgtcataaaagtctgtcgcatacgcggatcacgattttcaaacacttctgtgaacttcttagtcgcataacccggcacatcctggaaacgttttgtctttccatcttccactaccagatagtcttccatcaaatcacgtgacatactggaattgaagtcgaacaatgatcctccggcattatgagtacggcccaacgccttatcataatcttcaaagataatcatctctttattgccactcaaatcctggctgcagaacatagcttcataagcatctatatcgccagacttggctgtcgacaattcgtacatccccgaatccataatcttttggcaagcatctatcaccacccgcaagaaacgttcggagtcattcagattcaattccggatgatatttacgccagcagccttcatccagagcaatacgagcctgcatagccaaagcaccattcttaaaccaacgtgtccggctggttccggctgtcatattattaacggcaaactccaaatccgccataatagagtctacaaccaaggcgcgaggatcttgtgtcttatagagcaactccttgtctgttgtctgcaaatcacggctataccaaggcacatctgagaaagacaaaactttgtcataatacaatttcgcacggaacatacgagccaatccgatataatggttgatttccgtaggatcgccttgtgccttaccggctctggccaacataaaattaacatcccgaatatcttcccaatcccaggtgctccggttatcaggattaacctctccacgcatcatgctgtaaatatccttactttccgtataaatcatattatcggaaggagcatccgagtagccggaagtaatcttttcatacaaaccgtttgtataggcttccaagtcacttgtgttgttgaaaaatccatcttccgtgattgaagtttccggatgtttttccaaaaaagagtcgttacatccgcttaaacttaaaagaccgatgcacccgaacatccatatttttatattattcttgatcataacttatgtcttgctaaaattagaatgtaacatttaaaccgaaagaataggaacgctgcaacggataaatctgtccgcccaaacattccggatccatcttatagtatttgtagagacctgtgatttcacacaggttatcgccggagaagaaaatacgaagacggctgatattagccttttccacccatttctgcggaagcgtataaccaaacgtcaagttcttcagacgggcataggccgcattttgcaaataacgtgtctgcggaatagccaatcctctgttagcgacataggcctggtaagacttgacacgcgggaagaatccattcggattttctgttgtccaatggtcgttataattaccatacgtaagatttgtccatggatcataatacataccccagaaatacgggtcgcgggtcggatagtaatcctttttcataataccctgtataaatatgctgaaatcgaatccgttccaatcaccattggctgtgaaaccgaaagcataacgggcctgatcattaccgatgaccttatagtcaccatggtcggccaatgtgttggcacctttattgatcttgccgtcgccgttcaagtccttatatttgacatcacccggagccataggcggtgtaccgggatacggatcgacttctgtatggtcggcactgttgtcgatatcttcctgagaagtaaagaaaccatcattcaccaatccccagatttcaccccattctttacctacataatgatcgcccaaactacctgtttcattggcatattttgtgatcttagaacgactgtcgccgatattaaagctcgcgccatagttgaacggcttgcctgccagtttaaactggtcacgccagctgattgtcaaatcccaaccggtagtcttcaagtcggccgcattttccagcggaacagccgtacccaatactgacggcagtttcgcaccgcttctcaacatatctttcgtacgacggatataaccatcaactgttgccgtcaagcgattattgaagaagttgacatccataccccagtcggaagtcgtcaccgtttcccaagtcaagtcgccggctaccaatcccggagaagaaacatagacaggctgcttgccatccaatatgactttcgacttatcggaacccattgtcgccaaatagggataatagttgtctttcagatattgattacccaaactaccgtaagaaaaacgtaatttcaggaagttaaccacatctctaagaggttcaaagaaaccttcctgtgaaatgacccatgcagcagatccggacgggttgaacacaaagcgggaatctgtcgggaaacgtgaagtgccgtcataacgggcattcaccgctagaatataacgattatcatacgtataattcaaacgaccgaaaacacttcggaaagacaattctctgatacgttgagtaacagtcatgtcgcccgtagccaaattaggtgtaggcagtccgtctgtaatcagctccttgcgctgggcatactcataagattcagtccagctttcctggttgtaacccaccatagccgtgaaatcgtgcttgtcattaaacaacttatggaaagttgcatatgcatcgaaagtaaccgttgacgcttccgtattatcgaagaaagcggaagaaaccgagttctgatacagaataggagtttccggacctttccggtaagggacggacaactgtgcaccgtccttattgttccggttagcgacataagcaaacgaaccgttaacaaaaagaatatctttaataatatccaacttagtcgtaaactgcgttgtcaaagtagttttgttttctttcttacgtccgccttccgcaaaacgccccatgatagcggcaccatcttcagtataagaaccatccggattctttataggcaccaacgcattacgacggtttacagcccaataataatcatcccccaagaagtaaggagcatcataatcggaaattaccaaactggtattattgcccaacgtccaccagtcagccagtttgaagtccagtttggaacgaagattgtatcgattgaacttatctgttccttgcgaaaccataccgtcctggaagttataaccggcagagaaatagtagttcaaacggtcggtctttccggagacatcgacagtgtggttcgttgagaatgccaggttcttataggcttcgccaaaccagtcggtctgaccgaaataagcataagttccatccggcttcaggaaataaggagatacgctcggatcagacgaaacacgcttcgcatattccaattcttcctgattatggttcacaccccacggataatagaaatcattgcgtgctgttgccaccgtataaggatctgtaatcacctctgccatactactcagcttacgcatagcaaaattattactataatttacggtcagtttttcctgtcccaccgtcttcgttgtcaccaaaattacaccgaatgcagcacgtgaaccatagatagcagctgaagcggcatcctttaagactgaaatacttccaatatcggaaggattcatacggtttaactcttccgaggtagagacaacgccgtcaataacaattaacgggtcaccaccattgatagaggttgtaccacgtatgttaaaagtaggagagtccgttgcctgaccgctaccaatcgaaacagtcatgttagcgactgacccctgcaaggcttgtccgactgtcaggaccggacggttttccagtacttttgttgaaacagttgccacagctccggacaagtccactttcttctgtgtaccgtaaccgataacgacaacttcatccaacgattcactatcttcactcaaagtaatatttaccgcacttttccctttcaacacaatatcctgtgttttataaccgatataagagacactgatcgtcgcattaggatccacatccgacaacgaaaaattaccatctatatccgtgatacccccaatggttgtacctttcaccaatacattcacaccgatcagcggttcgccggttacatctttcacatttcctgttacagtaattttcttttgctgctgagtctcagcagcaaaagtaacagatctgttacttttttcgtttctacgtacaataatctggcgatcattgataatatactcaatatctgttcctgcgaacatattactcagtattgcctcaaccgtctggttgtgaacgtccacacttacttttctgttcaaattgatatttgaaccgtgatacacaaaaataaattcactgttcttttcgatgtagttaaatacatcttttacggtccggttgttcatgcgaacggtcaatgtggtttgctccgcataggctgatgctgcgtagatggcagatcctccataacttaccagacataaggctaaacatgcacttttaagaaaatgaaccggttttcggctgaattcttcattctttttcatacatttgtaatgttttttctttgatacataaattaatagattaaacaagagactttagaaccgagtgatatggccgtatcgttcggttcttctttttaatttaatgtctttcacataggcattctattttgatattattatattattattcgcatctgttttatattgaaggaacagggactggcagaggatactgatcacgtcttccatattttcccgcaagtccaacttcccggaaatggggatattcccaatctcttcattataccaaatcttacgtccgtaataacgagacaaccggtccagcgtctctcctactttccggtcacttaacatcatcatgttatccttccaacagatatattcaaaaacatctacctcctttacatccgtccctttatcatttatttcaagcatttgattaggagagagtatagatttagtattcttaccggagctgacttctacccgtccatcaaccaagacgacagaggccgacgcatcttccttataagcacaaacattaaactgtgtaccaagcactttgacatcaaagccgttagctttgacaataaatgggcgcgaagggtctttcgccacatccagataaacctcgccttcgacgacaatctcccttttatcttttttgaatacagcaggatagaaaacacgtgtaccggcatttacatacattctcgttccatcagagaaagtaatgtccgcccttctgccttttggtacaataatctggtttatttcttcttttttctcttttctatctcccgccgtttctttctttacaacgtgttcttccacgttcgactttccatctacatcgtatgtaatagacgattcgtccttcagctgcatcttctcttgactttcaatcagaacaatttcattaccggacaaggaagatgtgttattttcaagcaaagcaagcgacatggaagaatctttttttccgtctgtccagaaataaagaccgacagaaagaagtacggctattgaggctgcaacagaccatataaagcgggagcgcaaccggaatgaagtatgtggccgactcaagccagcctctatctcctgccaggacgccaatgcttcctgccgacgatcgggctctgcttcatgtactttccggagcaagtccttaccggcctgttcgaacgatttcttatctgatattttttgttttctattcacgagtaacctctttttacttctattacgggaaagagttcatttggtactcactttttttgaataaaatcaattattttttcgatataatttccgtagactggataatgacctgaatagcagattcttactagactgataatttattcccataatctcggctatttcatcatgctttaactcattcacgtaatacaagtaaataatctcttgttgatgggaagataattgtgaaaaggcctgcatcagatgtttggcttgattatcagtctccgattcatcaaaagaaagtaatggcatcagttcgtcggtcacgaacacttcttcatacagggaaatatcgtcggtggctttttccttttcgagtgtatcatacaatttattacgtaaggctttgatcaggtatcctttcacgtttgcggtagtggaaagagactggtagttctgaattagctttatgaaaatatcctggatgcaatcctttactaaatccttatccgagaccaatttggagccataattatacaataaagaatagaagcgacaatagatttctctaaaagcctctctatccccagtcaaacataatccccataatttttcatcggatatttgcatataaatatctacttatataattattgtaacagtctttcaacaacaattagaacgcaaaaataaaaatgcattattacactcatattacatcaaaattaagtaaatattagtatccggatcatataatttcataagctcataaatagtattacactcttaacgcatctatctttttgaaaataaaaggtcgaaaataatcctgttagaattaataaccccacggatgcaaatatagctcattttgtattataataggttaaataggaaagaagaatgtacgtctcaaattaccattaaaatgccccacttattttttacagtggggaatttcccccgcaccagtggggataaatccccattatagtgggttcttttccccattgcaatggggaaaactaaatacaaaagcttttcctacaaacgattcaagcacggaatatataaattccgtgcttgaaaaaagtgattataaagagttatttatttcactttgatatgatcgaacccttccccgtacacaccgataacagcactctgtgaaacaaacgcttccgggtctatatctttgatcagacggaaaatagtagtcgactcccgtttttttgccaatacgaacatcatctttactccgagccctgtatacaagccggttccgtctataaccgttacaccccgatgaagatctttattgatacgacgtcctatctcttcgtgtttcttggagattataaaaaattgcacggattgacgggcactatttactacctggtcgagcacaaagctggaaatatacaaagtggcaaaaccataaaccactttttcccaatcatgcagcacgaaataactggaagagataatgatcatgtccgtcatcagaatgacacgccccagagtaatatccctgtacttgttgataatggcagcaataatatccgtacctccagaactaccgttagcagaaaatgcaataccaataccgctaccacaaaaggaagcaccgataacacaagccatgaacggctgattaccaagcaggtgcaaaccagctgttgcactctgaatgatcggcaggataaaagtcatgaccaatacggcaaaaatagtctttacactgaatttccaaccaagaacaatcagggaagcgatcaataacccgccattaattgcaaaatacgtgtactggacattcagtccggtagcccaatacacaatagaagcaatacccggcacccctccggtagtaatgtcgttgggcaaaagaaaaactgtccacccaatagcataaaaaagcatgcccagagcgatcatcagataatcgtgcagctctctcagcattaactgccttgaggtaatcgataaagttgatttcatttcaaatgtttattttatatcgttataatgatcaccatgcctaaaaacaaattttgcagcctcaccaaaacgaagctgcaaaattaatgaagattaaatcaatttatcggtatgatccgatgaatttataaaaaacagattgttaatttctattacgatggatcaggcggtcaatagctccatgtatcctgccattctataacaggttggatgccttcaaagcggataggaagccagatatagcgaccgtcgatagcattctccggagtccagcggtcgcccatataaatgaactgtcccggtttacctggagtgggtaatacatatgtactttgtgaatggaaagaaagatcggcatccggcccggcaaatgggttttccagttcttcccaaggtccccggatggaagaagcaacagccgaacgtccggcattcggagcccacccggtacaacccgacatgatcagataatatttaccgtcatgcttgaacatggccggcgcttccataaaacgtccggggaagaaacgagcatacgtaccggaataactcgtataatcgtctgtcaattgtgaaatatgcaaagtactgttctcttcggaagaatagatatgataggctttatcatcgtcatcaacaaaaagattcatatcgcgggccatttgtccaccttccatatcacgtccgagcaggttcaggctgtccggatgtgcaggcaaactacctcccgtgaactggcttctgtctgactcgggaactccctgcttatgaatttcctgtacattttgaggccagtaaccggcattcggtcgaacggcacgaaggaatttatacggccccgtcacgttatcacttacagcaataccgctaagcgcaccggaatatcctgcccctttcggttccagatggaaccacatcacataattgttattctttttattatagatcactttcggacgttccaggatacacccctccgcaatactatgcgaaggatcatctttcacaacagataaagcgacaccttcgtccttccagttatacaggtccttggatgaataacaatgaacaccgaccaaggcattattaccggcagtaccttccgttttatgttcgccaaaccaataataagtatctccaacatggagaataccaccaccgtgagcattaatatgcaccccgttgttatcaggccacaattcaccgggagtgaaattcccgctacctttctctttacatcctgcaaacacaaaagtgaacaacaggatgcaaagctgtattaattttatcttactcatagattacacatcacaaatacgaatacatttctcaagagaagcgattttatccggctggcggggaacaaattcctgacctacaaatcctttataaccggtttctactatcgctttcatgatagccggataatagagttcctgtgtttcgtctatctctgcacgccccggattacctccggtatggatatgggagaaatattcgtgatatttctgaatattttcaatgatattcccctccatgatctgcatatggtagatatcatacaagagtttaaagttaggagatcctattcgacggcataattcaacaccccagaccgtatggtcgcattggtaatctttatgtcctacgctgttgagtaattccatagtgaggactacattatgtttttcagccaacggcatcaggcgttttaaacccttctcgcagttttcccaaccttgcaggtcagttaagccattacgcttaccggagaaacagatcagattagtcaatccggcctcagcaaccaatgggataacctgttcgtaactggctaccaactcatcatgcagcttcggatcattaaatccccgatcgatacccaggcctgcaccttgtgccatcgcaacggttagaccatgcttttgaaccaccggccagtctttaggatcgagcaattcgatagattcaatacctatctttttacatatttcgcaaaactcttccaactcataatcaccgaaacaccatttactcacggagtgacgaatattacctttcagcggttcgggagcttctgtttttttcttctttgccggatttacagcttccagcccggatacagctattgctgctccacctactaacgcggtcttaattgcagttcttcttgaaatattttccatgctattagaattgataattaattagatggtacaaatataagaaaagaaacgaacaatcaaaccgaagttggggtcacggaaagacgcttcccacggagttgtatccgtctgatcgttacgtgactgaagcataccggcagctttctctttttcaccgcgataaatagccgtacaccattgtgctacacgattttcagggaaatccgtactccaggcagctaccatacgatctgcttcctgtactttccccgactcgcgcagagccaatgcacttaacaggttaccggaaccaaaatgagaacgggatgttttatatccggctacagctgataataaagcggatgctttccggctatctccctgtcctgctgcagcttttgcttccagataatcctccagacggctgtcgatcatattatcataaggttttccgacacccagattctccggccactctttagaagcttccacgctcttcatcacctgtttataattcttatggttcagttgttccatcgcccggtacaaattggcctcacgataaactgcgcgtcccgcatacgaaccttcattcggaagaacctgcatccggctcaacagagagatacagggttgatactggcctgtctcacacaaagccttcgcatatttcagaccgatataatagttcgacggatatttcttcgtatacttctttcccgtctcaacggctttctgccactgattattggcgacatagtggttgatcaaagcaaatccggtacgccatgacatctctatctgctctgctttcaacaggtcagccaaccgggattcgccctcttttaaagaggcacggcttaaatagaatggtgcatagtcggcttcaccacaattctccagcagctccaacgcttttgccttatcctggttagcccaccggatcaaagcttcataataatcgatcttccagtccggctgtaccgccttcgcccattccaaggctttcaaagaagaaggacggaagggaaataccattgccggagagagagccgtggcgcgttgcaacaggctgcggctttcatcgtcgttgccagcctgatgcaataaataagcctgtttgtaaagagcaatcggatagttacctgcgcacgacaggagagacaatgcttcttctgtacagccgaccgattcataccattcggccagttccatataggtttcgaaaggcagttcgttctgaatcagcgactgaaaatcatcaataggatgaccggagccttcaccctggtagagctgttcaaaacgtgccgcatgatacagcggaagatcttccagcaacggatcgataagcgctttgactttctccggctggttcgtcttccgataaaccaccattaaaacatggtcagcactcagattcatacgattgaattctttacttctcaaggcataatgttcagcctttgcccagtttttatcgagcaggaacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattcatacgattgaattctttacttctcaaggcataatgttcagcctttgcccagtttttatcgagcaggaacatttctgctaatttctcataggctgcactacgtactcccggagaataggaagctaccgaaaaaccgtctttggcatccgtatgatttcccaatgccatgttgcataaaccatacagatagttgacatctccatcgtacgtgttaatgcttaatgctgttttacaacgggctagcgcttcgtcataacgtccctgacgataataaagggaagcaagatcagtcagtgcaggcacgaaataaggatctttttcgagggaagcctgtaaaaacgtttctgccttgtcgagtactttctgattcatccattgctctccctgtgtataaagaccatataccgagttccagtcaaaatcggcaggcagttgtttcgggcgactggtgatgttatccgaaggtacttccgaatacaccagcaagtcttcgcctaccacgactttcagtttaccggcggcaacagccttattcaatgggatagaatctttccaggtttccagtacaccgcagttcaacgggatggagttcacttccttttctccttcatacagctttatggttgtagataatttctgcaaaggagagaaatacaacttcagaaaaccgtcttccctcaacacgttaagcgctccgatacggctcgcctttgagactccttttattccttttaccgggaaccagtactcggtccatcgatccgttgcctgcggaccgaatgccgtatgtttataaggagttaagctactgttggaagcaggttggttgtacatgcgacccgattgcagttcgatatactgcccgtcggtatccgtcaataaatcttcccagatacctccctcacgggaaaggccccacaagaaaatcttcattcccagtttctcgtcataaccggcatgatggatggagccgaaatcgttgtcatgccagtaagcaccatagaaatcgttatactttcctactatatgatacgattttgaattgccgaagtcattcttttcataccaggagatatcacgcccctgttcatccagagggaaagaatggagttcgccgccatgtccgatgtagttcgttccaggatagcagaactcggcatttcccgctgccggatagcctgcgttcatccactgatagtaaggctggtcgatggatgaactgttatgccaggtcgttgttgtcgtaaagtaagccttatctttcggcagattcacttccacggtccacagcgtccgggttaccagttcataagaagagacataacaactcacacttccgtccggtttctgccgggtcacatagtcgaccggcgtactggaagtcggtgcatgaccgataataccgaagttgaactcgataccgcctgatgtccacggaccgcgcatggctatatcacggaacttcacgacgtggttattgtagataaactccttaccggtcgttttatctacagctccccatatttttccacctatctcaggaaagagagtcagtttgatataatcattttcaagagagactactttccattgccggtcggttcctttagcagaaaaaccatcaaaacggaaataaggataaaacagatcggagggatctgccaccggatccggatcggagaaaggatacgttttaactgtttgtacattttcggagactgtcgcctgttgctgtgcggacaatggttgcaatagtgcggtggcacaaagaaggatgagaatctttttcatggtaatttctttaaataataaacaattgtatataaggggaataattccccttatatacaattaaggagtacattttctgtaaactatactataccagcttctattattttgcaataattaacaagcctttccccttcggaaccgtgatctcatcacccggtttccaggttgcttccgtttggaaattttcgatagccggagcatacaatgttacttttgccggatcaagccccagtttggcccaatcgatagaaagtttaaccttcgcatcggcatcttcccaggtcgcgagcgagatcaatgtcttatctcccatacggcgataaatggtagacagcgtcttatcgctacccgtcttcaccggattatctttcacccaatagccgaccatctcgctgccctgcatgccgaacgaatcccacagtttccacaagggtgcgttgtctacccgcggactacgaccggtcataccatacagcattccgcgccaaggattacctccaccttccagcatttcacccatcagaccatacggaataccggaaacttcaaccagccagaactccggcggaaaatcataattgaagtattcaccgaaccacagacggtcgaggtaggggaaatgttccagatacaaattggcactattggcaaaaccgtctttcgggttatactgattggcagaatgcaggtcgatcatagcacccggattcgtacggttcatcactttgcggatacgcttcatcgtcatccggtcgaaagccaagtcatcgatatataacccgtcgataccgacgttcttcatcagccagtcgagaccttccagataataattatgccaacgggaaacgccactgttcacaatcgccgcatctttcaggtgaggaacaaaccaggcaccgatatagttctgatccaaatgttcctgtaaccaggagaaaccgccgccgggaccttccgagaatatctcgttccccagactacgcaaagcaaacatttccacacagctgttggacaactcacgaacggtattgtaaattttcaccttcatatcgcgagcgtgagcaccgtcgatgtacgctttcatctctttggtccgcaggaacggatagttgataaacggattgatagcattcgcatgatggatattgatgacattggcacctcgcttttgtatgccatccaggaactcatagttatgatgataacgttcacgccattgtttatccgtatcgatcgggcggaacggagtcaacgccaggttgaaataataatacaaccggtctcctttcttcacgctgcgtttaccggaataagcattaatacgtgttccatcggctgcattatggatatcgatacctccatttccggcattacaccaggataccggcatgtgcaacggtttctgatgatagaaattggtattcagcggacgttcgtatttattatcatacaggcggatctggataccggcattgacatcacctatccaaacagcatcctggtttttctctacatcccatttccagcgaagatcattcggacagtaaccgcctttctctcccaggcccatcatataacgtccgacaccggatactaaatgtgtccgcaacgcaacatcctccacagaagcatcttcgcgggcgaccaatgtcactttatattctatatttccatccgactccatctctccttccaggtccatcaggaaacggctgttctggttaagggctttccaggcgattgcaccttgtttatgtttggtgatttcgaagttcaggttttcccatgcaccgccatcggcagccagttccataggagcagccaatacactacggccattcgtaccgatgcccgtcatagtctctttgaaataactgataatatgttccggcaaacctaagtcagagagtttaacctcacgtcccaaacagctgatcgtcttatccttcatcaccagcggcgtataaggagcaatcacctcatcatcaaaaccgatctgcgagttcagccagcgcagacgggaatgacgccagggttcgttatctccatgattggcaattacattttccgaaacattcagagagacctgtacgttcttgctttcggcattggcggcagagacagtcactgttccctgataagtgcctgcagaaagatgctccggcaattgggttccaacccataatgcctgtactttacccttatccacagagcaattcttttcaaaaacggtaccggtcacatccgtcccttccgtattgaaacaggtaaacgaagaagccggtatctgctcgccggtcgctttattcgtaagggcggagaaatcgacatgcagattctcaacattcgaacgtgccgcccacacacctaactggaagacataatactctcccttatccgcctgcccgttaaagaaatcatgccgattatcggcaatccatttataaggaatatccgtagtcatgcgaatagggaatttgcggtcttccgtaaagagaatatatttctctccgggacgttcttttaataatcgggcagtctcgttcgatgtagcgatcacttccatcggatagaagctgttcagctcattgattgcctggaactgtacgactttagcagccggaagggcaggtgctttcttcccggacaatttatttttctttacccagtcagccgaagccgtattttcaaaagccgggtaattgacggtaggataataagggctgccgctcattacattcttcagataatagatataatattctcccggtacagtctgtggctgaaaagcgacctctccccgctcccggtcgatagcaaaacgacatacattcgtaatacgttcaccagttgcagcatccacaacgatcagattctttgcttccggggtcagatcgcgacgacgccattcgatcgtagccaatacggcatcggccggtttatctacagcgacaactacccgatggtttcccagggaatcggcattccatgtacccaccccataaagttcgtccgtgggtacagactgtgcttgcaaactactataggcaaacaggcaaaaaagtgtaaatagtaattgtttcatgtgtactagtatttatctttaatattgctttatacgattgatcaattcatcctgcggacgtcttttagccagatcggcgggatcagcctgctggataaagagattcttcaaacgtatgttttcttcattaaaaaacactatttccttgtcagagaaactatcttttaacagatcaagaggagtacataaggaataccccagttgctgcaatatatctccggctacggattcaaagatagcaatatcttcggaagataattcacgcaaaaacttttttgtattgtctttcaggatcggtttggttacatttgcccacattttgcctgctaccgctgtattttcagactcccggctcttataataatccatcaccctatcagaataaggaaggtgcaggaaatcgcaaagctgccgcataattttttccggactggcaataagcgtttcgtaattcagcataaagaaatgatcggctgccgtcctgtctttcaaacggagagcagcttcctggtctttcttccaattttcagccagtgcataaatatgtttctctccgacaatagcctttttaaacgaaagggcgacatcacgaccgtcccgatatagatagatataataaggagaaatcccggtagattcaatgccttctgcatacagcatatttttcatgcttttacacagccagaaagaagctccggtctgacgggccgccgattcataaatcacccggaacaattcatacaacgtttgttgcctgcaggctgctaccacttcatctgcacgaatagtaataccttcccagggaaccggattcactgtgaccaactcgcacacatcctgtgccaaccgataaaaattagactgatccgtcaaatcgccatatttgggaagcaacggtaagaaacgctgaagaatatgcggaggatggggagcagcgatctcccggattccgtccagcatgacacgcaacagattggaaccggaccgctgagttccaatcatttgtattccttgtattgtattcatagaattagaataagataaagcccgccacgcctgctccgatgatcaggtaaaccggactgattgtgtattttagtgaaataaaaaatgtaaccaggaagatgataaccgaaacaaccgacagcgtaatcgtctgtccgatcgtaacggctgaagcaaagatcattccgataacagccgcccgtacacctttcatggctgcttttacaacggatgactgattcagtatctttacaaaacgggataataagacggttaatacagccggcggagtgaacatcgccaacgttgccagcaacgcccccgtgatacctgccactttatacccgataaaggtcgctgtaataaatatcggtcccggagtgatctgtccgatcgctatcccgtcggcaaactcagccgaggtcagccagctcaaattctccacgaacaactcatgcaaagccgggataacgacatatccccctccgaacaaagtcaagctgataccggagaaggtcgatacgatctgaatactttccggagcacccggatattgtcctccccaaagtaatgtacagagtaatagcaaaagaacaaccccggaagtcatcagctgcctgctacccgtccgcttctccccatctgatatcaactcttgtcccacaggctggcgaaacaggaaaccgccggctatcccgctaccgatgatcaacagaaaagtaaccgtaaaaccaccgataaaaatcagcaacaaagccgccagcaggcaaacaacccattgggctggcaatttgatcgtcttacgtgccatcccgatagccaccgtaacgatcaaagcagtaatagccggagtgattccgctgaacacattctttaccgcaggtatatttccgtaggagaaatacaaccacgaaagaaatataaccagtaagaacgagggaataatgatcccggcaaaagctacaaccgcccccggtatcccccttagatggtacccgacataggctatcgtatttacggctacaggtcctggcagtacggaggtcagggaaatcccatccagcaaatcttcttctttcagtctcttgtctacctccactaactgcttctgtacgatagccactaacgacatatagccgccgaatgcagtagctcctagtttcaggaacgtaaagaaaatataggaaagtgatgtacgttccatatcacttgatttctttaaaatatttatcccaggtttctaccggaacatacactgcccgatagggggcatatagcatcgtactttcccaaagaacattacctgattgatcggtcaccaccactgaaccagtcttcgaactacattgcaacagatttccattaggaagctgaaacgcatttcccatgcgggatgtatacaaattaggaggtaacatcgcattgactgttgtctcagcagtacgtgacttttcatccaaccggaaagcttttgctccggaacgctggttgtataagccattatcaaaaagcattaaatctccattctccatgacatagggtgaatgctggaatgagaaataagctgttgtatccattttaaaatcaccggcacgcccgaagcgccaaaccagttcgccacttttggcgttcactttccaaatctgatcttcaatcggagtcgacaacaaataattactatccttatcgaaacaaagtccattgatatgaaaacggtcataacggtacctgccgatatagggatctttctctatgtcccatacatcccaggcagaccaggtattcaatacattacccaacgtatcgatcaccataatcccatcgccccccaatgtatccgtcaccattttgccatcaaccggaatcgtcgccactttcgtaggacgatataaagtatgtatatgatgattttcatccattaatatatcatgatgaatcacctgataatccttttcttcatgtattttatttaagtctacacgccacatcgtttcacctgtcagcgacacttccgccaatccggttccaccggcaaagccaatcgatccccgtcgcatcggtttcttatgttcatcattacggacttgctcaggtgtcattgtataatcatccacaaagtctttgacgaacggacgcaacatagccaggaatgttccttgtggcgtaatagaaactgcacgcacgccaatatcatctacttgccaataccaacgtacttcgccttcattgtcaatcagcaccatataaccgggcagtcggccaaaacacaataatatcattccatcccctaaagcagtcgtatcatgaggtcgtttatctgtaaaccaatggttgaccagccaggatgactgttcacgggttttaaaggtcagttctttggatttttgtttaaagaagttgtcaataatcacattatacgaatattccgtattcgctttcaaaagcaataagtcaatatgatgaagcgtatcggcagaggatatccgggttcgatacgattttccggaactcttgtctgtatattccacatacaccggtgcaggtttggctaatgatacatccaccctgttatacatagccgtattacgtggcgaagttaaagtaatagaaaccaatgcatttctttctgtccaatacaaataagccaatgcacagcaaataataacaacaacgattccaatcaaacgcttcatgtcaatctgggtatttattataaaagagaaaaagctaactcttctcataagaaaagagttagccttgaataattatttcggcaaacgagacggattctcagcttccaaattcggattcaattgagcatcattcaacggatacgggaagtaacgcaacgcagatgttacatttgtcggttttgaaatacccaatttctttaaatgagcatttacgatatcttcatatttcccgaaacggatcaagtcggcacgacgctggaattcaaatgccaattcataaccacgttccttcaaaatagccaaattcatatcttctacagaagaaggagcaggaaaacgatcatgtttaccatattccggagcaccggcacgagcacgaatctgattcaaataagggagagcagcagccggaccattcaaattattctcaatttcagctttacacaaaatgacatcagccaaacggaaaatacagattgtacgaccatcataataagcatctgaaatcatatcatacgaatatttcattgtagctatgttctgtagatatttagtcgtgtcattcggaacttccacaattccttcttccggaaccatataatggaaaccatatttagacttatcatcacgattagctcctccagtataatcatagtaataaaattcacgacgcggatcttccttatcatagctgcgccagaacggaagagatacaccgtaatactgccaacgacccggtacatccggatggtcattcggaccgaaatggttcgtgatttcaccaccattctgggaagattcatgcagaatagcaaagatcatttcctttccgtatttattgttttcagaccaaacatatttaaagtcattttccagttcataattaccactattcaataccatatcgatataggtctttgcatttgtgtaatcatgattacgtaaatagatcttacccaataaagtagcagcggcaccactggttgctcgagccaaatcctgaccatcccaacttgccggcaaaagattgatacactcctttaaatcagcaattaaagtcccttctatttccgatactggtgtcagagttgcattactcatactaaacggatcatcgatcagcgttgtaaagaaaggaaccggaccaaaagcatccgtcaaatcacgataacacaatgcacgcaagaatttagcctgtccttttaccagattcttgttttcttcagacatatcgacggcatcgactttgtccagaatcacattggcatttgaaatgaccttatacatatctttccagttactgctgaaatagcggttattggaatcgtatgtcattgtactcatcttagttgggtcaccggctgccgttgaatatcccatatcagtagcatagtccgtaatcatgactatataaccgccataatacatataagcatcacccggccccggggtcatatcagagtataacccaacaagagcagcctgaatatcagactctgttccgtatgcgttggctgtcgtcaaattactatatatttccggttccaggtcggtacaagctgtaaacaagcctgctgtcacaaccagtcctaacagacatttttttatcttcatatttaaaatctcctatttattagaatgtaatgttcaaacctacagtataggtacgagtagccggataagcgttaaagtccaaacctgcaccggcatttgcagtctgctggctaccgccatcctgacttgcttcatttgctttggtatccacttcagaatcccatccggaataaccggtgatagtgaataagttttcagcagagaagtaaaccctacaagaactaaccaccttcttgaacggaattgtataacctaatgtcagatttttcagacgcaggaatgaagcattttcaataaagtggtcgttgatataacctccgtactgtgaatagtaaaagccgttacgcggaatatccgtattcgtattcgtcggagtccaacggttcaatgcatccggtgtacgttcccattccaggttcatacgggtcatattcaacaaatcattaccgatcgaaccctggaagaatatggacagatcgaaccctttccatgtaaagtcgttagtcaaaccgaagatcacatccggattggcattaccaataattgtacggtcgcttgaatcaatcttaccatcaccgtttacatcttcaaacttcgggtcacccggtttagcattaggctgcggagcgtatgtttccccctgctgcatcacaccgatatatttgtaaccgaacaaagagcccagtgcttccccttcacgaacaatcgcataagattcttccgatacagaacccattggcttggaagaagtaatataaatatcgctattaccccccagatccgttactttgttacggttaactgccaaattgaatttcgtattccaggtgaaatctcctgttaagttatgagaagttacatcgatctcaaaaccacggttctgaatagcaccgatattacgctgtccggatgtaaaacctgtataataaggcaatggaactttcagcaacaaatctttcgtttttttccaataaccatccaatgtaacagataaacggttatccaggaatcccatatcgacacccacattgtactgagaagtcgtttcccatttcagacttgcattttcagggcttgtcggatccaaatgagtacccgatgcattgctggagccgtctaatgtaatatggttattagtaatcaaggcataagaagcataatcaccaatacgttcattacccgttacaccatatccggcacgaactttcaaattactaaagagattcagatttttaacaaaatcctcttcactggcacgccatgccaaagatcctgaagggaaagttccccaatggttatcggcaccgaaacgggaagatccgtcccgacggactgtcacagtagccaaatatttgtcgttgaacgtatagttcacacgtccgaaaaatgaagccagaatattttccgttttattggattgtacagactcctttatagacgcagcattcagattattccatccaaacaggtctgtcgaaaaacccttagccttcacataacggtactcggcatcatacttttcatatgagtaacctaacataacattaaggtcatgtactttattaaaggtcttcacatagttcaatataccttcaaatacctggcgggtagccctgaaatcacgtgtagttgccacccccccctcaatctctccctgataagtagtcgatttcggcaaataagtacccttgaagttatgtaacaattctacaccacctgtagctttggcactaaaaccttcgaacggatgaatctccagaaaagcagttccgttaaacttatcgttcgtcatatcattcttacgttccaacaagtttgccaatgggttatcgccacgaccaccaggaacacgaccataagtaccatcatcattatagggtttcacagtcgggtcatattgcatcacactcaacaaaacatttgagttgacaatattaccactatacatctggaaattagactgttcacgatgagcatacatcgttgctcccgccttgatataatcattaatcgtttggtctacattgatacgtcccgaaatacggttaaagtcagtattcttcaaaacaccttcctgtttatagaaacccagactggtcaatacctttgtcttttccgaaccaccgcggaactgaatattatggtcttgtaccaaaccgacgcgcgttgtttctttcaaccagtccgtatctacatcagactgcaactgagacggtgtataggcaccattcggattaccctcttgaccttcaatttcctgatacagtgcattcttcagattcatataatccttcgcattgataaatgtaaacggattatttattttttgggcaccaagataaccattgtaagaaatcttattttcaccagccttaccgcgtttcgtagtgatcaatacaacaccatttgcaccacgagcaccataaatagccgttgcggaagcatccttcaatatctgcattgattcaatatcattcggattgatattcaaaccttccgaagaggggaaaccatctacaacatataatggttcattcgtagaagagatagagttgctaccacgaacacgaactgtaattgtaccacccggtgctttagaactctgctgtacctgcacaccggcagtcttaccttgtaaagcctgagccgcattactaacggtaccacccgataccatatcatccgccgatacagtagaaactgcacctgtcaggtctttcttctttacataaccataaccaatagcaacaacctcattcaaaccaatggcctcttcagccaaactggcattcaccacagcctgactgcctactttaatttctttcgtagtatatcctataaaagaaactaccaaggttgcattattaggaacgcttaaggtatatttaccgtctatatcagtaaccgtaccatttgtagttcctttttcaacaacatttgcccctggtattggctcaccagcattgtcggttactacacccgacacctttttggcctgttgagtgatcataacactttcattctttgctttcgctgcatccattccggtcggaacagcatacgaagagacgagggaagagatacataatccagctataagaccggatcttgataacaccttccgcgtttgagaatccgctgcccttgcagcaagactgtcttttagtaaagcgttgttcataaattagaattattagatttatatctgcattacaatagcatcaccctttacagtaaacttgtcagaataccaacaattgaccagagtccaataagaactcgttcaaaacagaccaaaccagaaatgaataatatacaaaaatgactttagagaggtcctattcataaatatctaaatagtcaaagtgttaaatccttattatttttaataaaacgaactgatattagcgtattttttatatatttggcaaaaaaattgaacgagttcttattggactaaatcaactaattaagaaagatcgcatcaaaagaaacattgatattcatggtaaacggttgggacaaagtgaattctacacaaataagacatttatgtatttaaccaaatagtgtttttattgatctattttacacaaagcagggcgctttcctttaaaatccaaaggactatcattattcgtgcaaacaagcctgtcaattcattatatctatcagaaaggaagaaaaattaaagtattttcgaaattaaccatcatactatcatcttatcaataagatccttgaatatcaatcgatatataaatgatagttatttatttcaaccatcattcaactaacataaactatcataaaacgacctattcaaggtaaagcatcataaaaatggacataaaaaacgatcagacacagaccattttcttcatagcaccctatattttttgctcaactatacctacttttttcacgaaaactactaatgcttcctcttcagccccccattttatacccttttacacccgggtttgaacgatgctaagacccgggtcccgacaccctttacacccgggtctcaaaaaaaataattagttactttgctgaaaataagccctgtagactggaagttttgtcaggctgttttatgatagtatgatagtagaaaatggaactatcacaccaaccatcatgatctttacatattgatattcatcatatataaagccataaatgatagtatgacagttatattaaacaatattgaaatagaagaaccttttcatttctctatcaccagccaggtattcccacgggcaggaatagtcaccgcaatatctaccgtataatcgcgattcagcttataggtaaccggagcattctctttctccctgatcttcgctacatcggagataccagtgtaataaagcggaagccgtatcgtacgggtgataacctggtcggtcgggttgaacaacagggcaaagcctttctccttcccttccggatcgacatgcataaaaccatcccagtcacgtccgtcggcacggcgcaggtggatcagttcgctgttcaggatattccggtacttcttataccagtcgatcacttcaacgacagccgctttggtctccggcgtgtcatatagacgaggaccacggtaacaagcctgcacaccggctccatagttctggatcatgtgcgctttatagtcagggatgtgatcttttagaggctccagcgtggcagcagctccaccaccatgatactgtgtgagcggaacgaatgtccagcacatacccggcaaacgttcccacaggccgtcatacattacctgacgtcccaacacaaactggcgttcacgcggaagcgaccagttcacttcacggtaaccgataccgaccttcgatccgccattcaacatataaccgcaatcgggaatattggtataaatacctgtttcacacatccattggtacagatcgactatttgtttacgctgcttccattgagagtctttcagccctttgtgatatgcatgagtcgtagaagcacaaacatttcccggataagaaccatcgttttcaaaaacagtcattccggtcttttcaaagaagcctcgtactttgcggaaataatcgtttccccattcgctggacaagcaaggggaactgccgaagatcatacctcctcgttttcctgtctcggggttgataacgtccacctcatcactgatccaacggctggacagcaaggaataaccgccaagttctatccctttggaattagcatactctgtaaattctttgaatttggcgatgttcgcctcactttcatcctccatattcaatcccgaaccgaaactcaggataaccatttcatatcccgtctcggcacattgatcgatcgctgttttcaccacctccggatcagaggagacacaatgcaggaagatcggattttcggttgtccagggagcgatcttacgatacatccgtttctggaaaagacctttccgttcacggtcgtcgctgtcgaatggcatcagccaggtacggaaactctggaacttaccaccggcggggatatcttcatccggtcccatcggtagttttacctccagcaggcaaggggtcagcaacggatagttacattgagaagtatatcgcgggtcggtattccagaattcggtgcggtcggcttcccgttcggtgaatcccagaaacgcccagtcgctttcgacatggatattgggtttcaggaattgttcggggcgcttggcttccaccggagattcgggttctgccatagccaactgttcaagcgtaaactcatccaatgttatctccattccggtttggttatcaatttcaaaccatttgctgatacaagggataccgtcatagagggcataattcagtttcacctttacacctttcaggtaatccggcccttccagatagaaagagagcaccttacctgaagtctcacccggcttcacaagcgaccagcgtttgtttgcccactcgatacgaggagtgagttccgtaacgtcgaatccggttacacggaatgagttcggcaggatggtcaggctgtcaatccacttatattgcgtatagccatactcgaactgaccgtcgagaccgcccaatgtatagattttatcgtcaatctttaaaacaccttcattactaacggcacgaagcatactctcgccggtcatctgattgatcagatcgactgtggcaagattcggatagatacggaatacacggctcaccagtccattggacagcacaatgtcttttccgttatgtgtctgataaacgccggctttcactccttttgcatccagcaaccaatcagacaggggacgtgccaccggcaggtcgatagtgggcagagtggctatgtttctacgcaacgttttttctacctctgcaggcattgtctcgatagctcccttataatctgcattaaccagtgaaggtttgatttcattataggagaaaacggggtcgatccagtttgcatggtcgccgctcatgccgtcgccaccatcatccacgatcagttccaggacatctatccccgacatatcgagcgatacttcacgggctttttctccaccgcgaaccattccgctgttatacagttctttcccgtcaccaaccaggcgaaagacgacacttcctttatccagagaaccatccccggaacctactccgacaaactgctttttccctccggtaccgtcagtacgataaaacagcattgtcccgtctgtcatcggtatcttactgaaatcttcttttttgtaatccaatgaatggtcgtttaccccgaccttacaggtaaattgtttggtattattccgcagactcagtttaatcttactgttggcctgtacgcctattccctgtacgaactgctcgccggctatcgtcagcttctcaccggtaacggctgtgttcttcatgggtgaaccatactgctgataggccagagacagatccatatcaggtagaaaaattgtattctgggcactgacatcccaacctgtaaagaaaaatcctcccataaggagaaataaagaaatagtctttttcatgctagctaaaagttagaatatatataagttcccaaagatacttaaaatatctccgtggactacattcgtatcaaataacatcttatttaccccagccttcattcggggtatcaccgagccacaactccagtactcccccttccgaaaaggcggcatgagaaatccggaaagaattatactcttttccgttaagtcgtgcacgttggatataacaattggaggccgaattattgtaagtctttattttaaaagaccctcctttataataatcagtatccagcgaaatagtcacctcatcaaacacaggacttgttatatcatattgcggatcgcgggaagaaccaccatccagcgcaaacaatccgattgccatcaaggaactcacaccacccatttgtccctgatcctcatcatgtccgccataccctctgtcgggagtaactgctccataagcctgttctttcacgcgacgtacccagtattgggtcagccagggttttccggcatgcgagaagacgtgagcattcgaacagcccggctgattagcatagctgacatagccgctgccgtatccatagacaaaatcagtttcttccgattggcggaaagcaaaatccagcttactgcaaagactgtcgttacctcccatcagctttgctaatacaggaatatcatgcgaaagtccgaacgttgcctgccaggcgttagcctccacatatccgtttccgctcaaagggtcggtatgcagccattcaccattggctttcttcggcaggatcagccccagctccttattgaaagaagccggccagcctgtagcccgtttatggaaatagtcataatcgcctttctttcccattttagctgccatttcagccaaagcccagtcctcgaaggcccactggatggtcagaccggcattaccgggacaatagccgttacggacatagaagtccagctccttatccattcccaatgccagcattcctcctttggaatgatttcgtttcatagccttgaaagccttttgcggatcccatttccggacaagtcctttctggaaagcactcgtgataagagaggtggcaggacatccggacatgatataggaatatccgccggcacaaggtccgcggggaagcaggtttccattcacgtcatactccagcagagaagccgcaaagtcatccagcacggacggataagccagtccccaaagcgtattcagattccactgtgtcaaccaaaatgcatccgagttgtacatatgatgtttcacctttccctgtccgtctttctccaactggcgcacatgaaaacggatatttttcgtctcagcccctctccgggttccatccgtataatccggatattcgccgttggcgtcatccagtttatgtcttcccaataatgagtgccataagtcggtatagaacttcatctgctggttatggctacctccctttacattaatcttacccagccattcattccattcctgctgagatgcttgccgtacctggtcaaagtcccagtggtcgcaatcctgcttcaggttatcccaagcattctccgtgcttacataggaaatggcgactttcatctgtaactgttcgccaggctttacctggtaattagccttcaccccggaagtaggggcatcatgataactcattccctgatttctcggagtactctccttcgctccctgcaactcatcgatatctttgaactgttccgggccaacccaaccgtccagtgattggaaaggtgtatcgaatgtaacggcaaaatagattctgactacatcaggtcctccccacaatcgtccggtcgtatcaaaataaccttccacgccttcatttccctttttatagacatgggcatttaccatcgtcgaagtgccgacatacccacccagattcaataatatatccgccagattctcttccgtataagtgaagcggtaaaagctgacacgatcggtagccgtctgttccacccagactttgtatttatccagaaacagcctgtgataacccggttgaacaatctctccctgatgcaggaaagaagatttccaaagttgttccccacctgtcggatccacattccctgtcaccggcatcattgttaagccggaaagcatccaacaatggatctgtggaaaacccagaacctccgaagagttataattgtacccgcctccatattgatttttatttcttgtcagaggtgctgcaccaatcattccatagggttgatttcctgtaataaagaaaaagtaacgcccacgggctgtctcgatataaggattgacccacgatacgtgatccgtataatcctcaggagaaggaaagacctcgatctccgaaaggccaacctgcgtaccagcggcatccgtgacttcgaagcgtacccattctacctttcgtgattcaaactcaatttctttaggacttccatcgttggcaatactccacacattaatcttactgccgtcactgaaatgcaatacacctccggctatatgggattctttatccgggcgatcatacaaaatgattttattgatattgacaggacgttcccaatccagttgtatccagggataatcgatctgtccccagaatgtttcagtactggcagacacccactctccttttccctgtacccgaatcattccatcgattgccttagtcgcatcatgaccggcatcaatcgaagaagaagccgatgcctgtgcttgcggggcaatgttatagggagtcgcccggcctataaccggacaacaactcaaaaacatgataaatagtgaaaagaaatatatctttttcttcatatattacctattccgtggattattattgcttattgcttacggatatgcgcgccacaaagcctcctcctgacatcaattcctctttaatcctctgtccggagcgtattttacttttctttacttcaatcaacttccggttttcgggagtatccgaagctatctccatatgatatttccctttaggcaagaaatccaactttacatcaaacgtcctgggtgtttctccgtttaataccgtcaaataccagacatccccttttctccttgccaaagcagccaactttccaatctcactttccggtaagactatcgtttcatcccaggtaaccggaacactttctataaacgatcttcccggacatgacagcatatcttccatatctgccgcaaagatcaacatcggggatgtgaacatatagatcgatgataactgatgtccaaaggtcacagacggatgacaaaaattacgaaagttcaacggtgtataatccgcaggtcctgccagccagcgagtaaacggcaacaccgtgttatgataaggccagggtggacccggagcccaactattctctccgccaacacattccagacctcgcacggcctcttttgccaacaagttcggataggtatacgaatcacctgtcggtttattaacgccatgaaagattaccatcagtttctctttcgctgcagccttgagaatattctccatcagatcgaccgtaaaggcattctccgtatgaaagaaatctattttcagacctctcacccctacttccgcacacttcttcataaaatctgcacgttcttctgcgtcaactaaccccacatcagatttatttccaaaccggggagatgaagaacgccatacccagatatccacattcttcgctttggcataatccaccaaatccttcaacatttcccatttggtccgtccgtttgcctctttttccgtttgctgccacagttcccagccatcgtcaaccaccacagactcaatacccagttcggcacatccgtccacatattttttatgattggctacactcagccggtcattgccttccaccaaccaggtgaacgttgctcttcccggcttaatccaatctgtttcagcccctttcgggaaaagagttttatcaggttgatcggatacttgagctataatcccgttattcaccaatccattcaagtctttagccagcataagaacacgccagggagtaacaatttcatgactctgctctttaggagatatgatccatggtacattacgtactgcttcatgccaatatttagtaggtggaagaccggttattgttcctgtctccagatgtcctttattttccacataaccgaattgtacccggttcggagctgtaccgaacagtactgctccatgataattgaacagatttgcttccgtgattgctgcataaatcccattcggcagatgaaaagtggcaggcggagccagtaactcaccttctatacgatcggtctcccgctcctgatactgctgcaaccagccatattggaaaggaccgctggcataccagactttcgtctgtgacggaaagataaatgatgtttcctctccgtaaatacagactggtccctctgccgggatacggtaacgcaaggcaatcccgtccggaaatattcggatatccatataaaaacgacttccgtcgggttgctgtaactcatagacaagcgtattattttcctttttctctttgttaagcagctgaacgtcttttcccagttgacggtggtcgacattcaaacccaaaggggcttcccggataactgagttttcctcataagagacatccagcaccaattgtttatcggcatttgcctctactttcaactttaccggggtagcaccagacacggcgtcaacttcttctccttttacgatctgatttacactcaataaaagcagtgctatcgctaaaatcttcgatatatgattattcatctttagttatattagggttccaaactttgaaatggtaaaaataagaaaaattccagtcgagacttttataaaatacgagcattattttgcataatccgagattagggaaacaggtttaaccgtatccccagtctcggatataactattttgactttactcttggattatttctttgtcataaaccggaaattataatcactgaaggaccagactttcgctccttcagaaataataactttacctgttttattcccattcgcatccacctcaactttcagtacaatgcgagagaaatcacccttctcataatcaaagctcttcccatcatcatcatacaaattataagaagaagagactttgccatagtgacgtacttccagaggaagtttctcgtctttcacctttgtcacagcaggccataaaggaatgataccaccttctttcacatataccgggatcttcgacaaccctggagaaactgttatcacctctccttctcctgcaaactctccggtatagaaatcataccatttaccctgaggtagaatcacctgacgatctttttctccagcaaataacggagcgacaagcaaactgggacctaccataaactgatcttttacttccttttttacagccatcgcataaggattgtcagttgcatccaacacccctttttctgttttggtgtccgcctgataaccttcttccagattcattgcacgaatcggaggagttccttcaaaagtataatcagcaaaagccgtatagaggtaagggatcagctgcatacgcaactgagcaatctcacgtacttctttttccacttcagggaaactccagggtttcgttccgtccgcccaggcatccaattgagccacaggagaaaaacaaactgtctgcatccgccttaaccattcttctcccgttccggaagatcttacctcgggcgtccaaaggacaccgataaaagaactgtttatcaaagctgttataaaatcacgatgggcataataatcattatagataacataaggatatgaacttgtccctgcattcccggcacgaaccaatccgtaagttcgggtattacgtttacggaacatattcatcgtcacactctgcatcatagaaccatatatctgacgcatctgttccgcaggtattttggaaggaaaagaagcgacatcgggccaaagccaggaatcataaccatcattttcatccatcttatatccactaacacctttatccaattgatgtttttcaaaatgttccaccatgatcttctgcgctgcaggcattgaataatcgggaacagttccacaccataccgtatgtgacccggtataaggttctattttatcgtatagttcgccatccggtgacacataaggattgatccatacattcgtttttatatattggtcattcaagcttttaacaaaattatccggatcaggaaaacgggttttatcccattcgtaagtacacgggtaagaacggctcatccaaccgggttcaagtccgaccacgctcaaaggaaaacctcgcttttcaaactggataacttcttcattgacttctttatcggagaataaagagggcacacgatgccagaaaccaagcccccatctcggaggcaatgctccaccaccgttatacaaattaaaacggcgaacaacgtctagcatggtcggtcccgcaaacaggacaacctcaacaccctctgccgggatcagaaactccagattatccgaataaggttgagcttcccaatgcttatccgtatttctatctcttacgacaggcggattcttactatctttccgtacactcgtaccgacccatgtatcaatataccgggctgaatttataaatgctccatatccttttgaagatacaaagaaaggtaccggtgtatgtgtacgcccatcgtcttttcctgtataatgatctacatgcaaacgcatgatccgccctctctgttcaaccgtcttaaagttcaaccccaaaccgaatatcttttcatccttttcaagaggaaaacgaatataggtctttccatcgaccacttcaaagctgatatcttcccgagatacaggcagtgaaactgcccccattttctcgatagcatcaagtttgggagtaatattcaattcactcagtagatttaccttctcgggagttcctacagagacattccacacgcctgctgtctcttctttccacttgattacccctttacttcgggatgaattattacatgcactcaaaatacaaagagtacagattgtcacaaaatatcttctcatatatcctacttaaaaaaaggcagaaacacgggtctctgccttctgttattataaaaaaatcaatctaacgggttgaatgttccaccactccaaccttgagtctgttccatcttggaatttgtttccagatacttgttaggtatcgcatagaaatagtagttatccttaaaatcaatagcaaaattcttatccagaataactagcgagtctctgaaataagtagcataattattctcaaaatcagccgtatcctttatcttattaaattcctcttccggtatattcagtttaggcaaaattccatgacggactttcccgttcaattcagtttcaaacagacgccaacggcgtaaatcccaataacgtttaccctcaaaagacaattccagttttctttccaacataattgcttcaatcatttgtcctgacgacatgccagccttcagtccatacataccattattacctgcaagtataccggctcttgccctgatcgctttcaatacatcataagcctcatctattttacccaccatagctgcacattccgcatagttcaacaatacctctgcatggcggatttcaatccagtctgtactactcctttccgtgtaataagatgtatagctaggatcgacagcctttctacaataaaaaccagttgctgtaggaccattcaattcagcccccacatacgtccattgttttctaccggctttgccgctcaactcccatgtacagctattgtaagcgatagtcatattgaagcggggatctctattcttccaatacagaacaggatcatactccttagattcagtaataggaacacccgtcaccatgggatatgactcaaccatttccaaggtaggatgattagcacctgtataattctgtgcctctgacaatggacgagtcgccgcattccatttgtttgtagttcccggctcctgatatctacgcccccagacaacttcccgattcatctcatcataccatatcttttcataactggcatacaatccatagccatttgcttccaactcctctttcgcctgtttattcactttatatgcagcttcccaacgatccatccgattatcaggattgaactgaggactggcataaaacagtagaacacgccctttcaaagccaatgcagcagcttttgttgcccgtcccagatcatcaccagtccagctccaggggagattttcataagcataatccagatccttgatgatgatatcgatacactcagacgttttattacgtgacactaacaagtcatccgtaagtttttgaggtaacagcagcatcggaacaccaccatagacacgtaccatgcaaaaatacctccaggcgcgaaggatagaagcctgagcctttaaacttgtacaagtctccgtatctatcgcctcattattctcgagtttctcaaataacatatttatattacgaatatcttcataataccaataatcgcaggaagccgtcgtcaactgaccatacatcacactgccgccgccatcagcctcatccgagtaggaggaataaaaaatagaattcgcaccatctccatccctgtcttgttccccttcccatttaggcaggttcttttcatacagtctgttcaggtaagctgttgcatatttggcgtctccccaaacctggtcgtctgtcacggctgataaatcctttttattcagtatatccgaacaactcacactcatagccaacaatgagccgtataataaatatttgatagtcataatgctttaattttattattaaaaactaaggttcacaccaaaagaataactcttcatcataggataatcgaatatcgttgaactttccggatcataatatttcaccttgttctgaagtaaacacaagttatttcctgtcaggaagaatttcaactgggcaattcccaacttggtcaatacagatttaggcaatgcataagaaaggttcacatttttcagacgcaggaaggaaccgttacgcatccagaatgtcgattcttcaccagctgcattacgggatgcacgcggaaaggcagcattcacattctccggtgtccagtggtcagtccagaaatcgaagttcgtttcctgcggacgtgcttgggcacctctcatagcgatcataacgtcatgtccggctactccctgtaagaatatatccaaagaaagacctttccatgaaccacccaaagaaagaccgtaattcaaaggaggtgtcgtatggttcataatccagtctttatcattatcatcgattacaccatccggttcatcactgttcgctccacgcaagtctttatagttcaacattcccaactcaggtttctgtccaaagatcgtatatccttccggcagtgcatccaaatccgcttgtgtacggataatatctgttgcgatataccccattttacgatctgtactataccctatctcagacttataagaacgaaggttctccgcttcatcttttgtgatcactttattcacggcatatcccagattcccttttacataatacttgaaatcatcaccgatcttgtcattatagcctaactccacttcaaaccctttagcatcgatcacaccatagttttcagaaggcatcttcgcaccgaaagttgcaggaatactggctgcccggtctcccagaatatcatatgtatgcctgtagaaagcatctacattcattgacaacttgttgttcaaaaaagtggcatcaagaccgaagttatatgtcaaagacttttcccatgttatatcgatattgggaattacatctgccgtaacaccgctgctcaacgagccgaaataagcaccattcactagattataacgttgcatccattgccatccactaattgcattcttatctttcaggacaataccgtcattacccagcaatccgatagaggttcttaatttcagatagttgataaacttaacattctctttgaagaatttttcttccgatactctccacgccaatgaagcagacgggaaaaatccccaacggttcttaggagcaaaattgacggaaccgtcataacggaaagaggcttccaccagatacctgtcatcataaccataattcaaacgaccgatgtaagatatacgtcctgtttcttccccttttccatccactgtagagtttttcgaatcagaactaccggcaaacaattggtcgactgcagaagaaatgaaataatttctcaccccgttaaaccaatcgaccgttccttccgattgctcataaacaaacaatgccccaacatcatgcttcccaaacttattggcataagtaacataaccgttcaactgataactgtctcgggcgtcatatttttcttccagaaagtcaccgtcagatcttactttgacacggtctatcacatctgttataatatgattatgaccaccggtcattttatattcatacaatgaataagggcggttaaactgttttataaaagtatgcctgtcgtatttattaaataataatttaagacttaaacctttgacaaacggaacattatattgtaatgaaatattcgcgtcataattagaatatttttttctgttatagccggtattacctcccagcaactcaatcggatgccattccacaaaacttccggtcggcttcccgtcaatatacggaggtacttgtcctgtccggaaaagcaggcccctatacaggttatccatcttatcagaatcattgtcatacctccaatatggtttatcatcatttctagtatccatattcagattcagagaaacgattaaatcttttgtgatgtttgcctccagattacttctcaggttgtatttcttgaaactcagattattgaaagaacctgtttcataataatagttaccaccaataaaataacggacacgttcgttacctccgctaacattcagagaatgcctggttaccagcggttgcttccaggcttcatccagccagttataattgttctttttgaagtactccaactcgtcatccgtataataactcaaatccgtcgggtctacattttccacaattctattgtcattgataaaaactgcctgattgtaagcattctgtgtttccgggatcatagtagcatcggataaaccgatggaaccggtataagcgatagtcggctttcctattttgcctttcttggtcgtaaccaatactacaccattagctgcacgtgctccataaatagcagcagatgccccatctttcagcacagacaaattttccacttcacttgcatccaaaccgtcaaaagcaaatttatctctgacaataccgtcgattatatataaaggagccgagtcattccaggttcctttagaacgtaccgtcatatccgcaccggcaccgggcttacctcctgattgcgtcaacaatactcctgccattttaccgacgagcgcactggataaactacccgccggagaatcctgtatatcttccgcactaacagaagagacggatccggtcagattcacttttttctggataccataccctacaattaccacttcctccagtttctgggtatcttcctgcaattttacattgacggaagttccatcgtgtacagccacttcctggctgatataaccaatgtaggagatcaggagagtttttccggatacattatccaaggtatatttaccatcgatatctgtaattgttccgttcgtagttcctttctccaccacattggcaccgataatcggctcaccgttagcatctgtaactatacctgtaacattcccttttttcgcctgtgccacaaccggaataaccgaattattaatcttttccatcgggttgatcaaaataaggttgttctctgtgatttcatatctgattccttctttagcaaacaaacggttcaagatcgtttcaacactctgctctttctcacgtacagacactttcttatccaggtttatctttccactttcataaataaagcgaaattcggactgattctcaatcagaaaaaggatttctttgatagactggttgcttacgtccaacgacaacttcgtcttttgggaataaacggtagccgagatattgagcgagaaaacaattaaagctaaagctgttaatctcataatagcgtatatctttttaaggaccggatatgattccggccttgaccaattaaaaaatttcatatatttgtaatttgatagttagttaacaatagtgctggaaacactgtgaattaatgatcaaaaaataggacgggaagtggttgcaacatttcccgtttttcgtgcttcatggttgtttcttcataggcaaattatttaggggttatacttatattttttcctttcacgtgataagctatattacttaaatgggataaggcctccaatacatccgtaattgtttcttcctgtattacaccattgtaatgtatgtttttacctaaaccttcctgaatatgaatatcgacattataccatctttccaaatatttacaaacatcagtcaatgacatatcatccatataaagcttattattcagccatccataagaatgggacaaatcaccgctaagctgtttcaatgtactagtccgcttattgaactctgccatatcacctgctttcatcttcagtttgtcgttattatgtcccaattcaatgtgtccctccaccaacgaagcttgtacagtcgggtcgtctgcataagctctcaggttaaaagatgtacctaatactttcacctctactccatcagtcattttcacaataaaaggggttttacttttcgatacatcaaaatatccttccccctggaaacggacctcccgaattttcttcttcgagttatatacataagtaatatccgaccctgaattcaactttacaacagacccgtcaggcaacgctatttccgaacggttcccgtaatcggcggtcaagctgacagagatatcctgctccttatcaaatactccggtaacagaaagaatgaccatcaataaaacagaggctgcgacacccgataaagtataataaatattattcacacgtttccggagaagagtcttctgcctattggatgtatccactttttcccaggcacgatccacattgaaaataccgggatccatataatgtccggattcctcccaaattctgcggtatcgctccagctcctgccggttctcctcatttcgatccagccattcctgtaggaccgggtcggtgacctctttttcaccgctgaataggtaatctattatatgatcacttatatgttctttttcttccatgaatcttccttttataattaagacacagtaaaacaaaaaaggtcctatacggacctaaaaaaatttatataccttttacctccaggcactttttcaacctctgaagggatgcccaaatctgatttttaattgttttgactgaaatagataactgctctgcaatctctttctgcttcagtcctttgacgcggtgaaggagtaacacctctttacacctgccaggcagcaggttgatacaatcgtaaagggccatgcggaattcttcagtctcaagcggattttcttcgtaataaggaagttgtttttcccggttctctaaaactgttttgtaattcgtttgtgtacggatatgattcaatgccagatttctcgccatcttatacaggtaaccggaaacattctcaccaattgctagcctcttccggttgttccaaagggtaaggaatagttcctgcacaacatcctcagcatcctctttctctcctaacagacgatagacataacaacacagacggctgtaatatcgtataaacagcttattgtaactggtgtaatcatcatttgtgattgcagcaattagtttttcatctgtaatagagacattcaatatatattaattaaatattagataaatatcactctgcaattatcacgactgcttcttaatgacgtggttgtatgaagtaattaaaatctttttctatataattacacgctataacccaatgcaaatgtaaacttatttttgttataaaaatagtataaaactatttatttgatggactattctctgattcgccaatcacctcttaccggaaactgtcacatatcgtaaaagttcgcaatgcccgtcaatatccattactccttttttatcaattcactttcacgatacctttacaaagaaaagcagtatatcttcatgccccaatattcatgcttaggtaaaatacacaaaacggctaggttttttacatcgcatgcaggaaaagaaaaaagcaaggtagattgttatttcccatatgacaagcaaagactttatcgttttgtccttatatttgtctcaaataaaataagttcgatatggaaaaagaaacagaagagaaaactcaaaagaacgttcaccagggtgcaaacgtccgcagattacgtaatataatgggtgtcaaacagagctcattagcgaaagatctcggcactacgcagcaaatggtttcacgcatcgaaagccagcgggtgatcgaaaaagatacgttgatccaaatcgcgaacatcctaaatgtttcccccaagatcattgaagaactggatgaaaatccgctatcagtcattattgaaaataataattttgaaagtggaagctataatacaggaattgataactcaaatgttggagaagaaaatcatcacaatacaatccatcatcccctggataaaatcatggaattgaacaaacaagccaccgacctttttgaacgcatgctggccgttgaaaaagagaagtccgccttgctggaacaattattgaaggagaaagggtaatattcatggttactacccgatataacctgaatttcatcccaaagtgaagataagatcccgtcgtagtaattgcttgtcgacaattataaacaaatttgccgataattgtgagcaagcttgccgataactatcaacaagcttgccgacaattatcgacagtaaaatagtacaacagaacaacagcatattgttaccgttctaatcagataccggtaaacaatattccttgcttcctgcccattattatctatcattctccggtaacaaccttaaatgttgccagattacctttatggtctgtcggccaaattcctttcggagtgaagaacttgtcccgggaatcactttcttctacctttccacggataacagtttcagacggtccgaccagaatacttttttctagtgaaactgaagcattggtcggataataataaataaaatcgatcctatccctttcgtccacatccggagcccatgctaacttttccagcttggcttcttccgccaacttatttccggccgggaatgtaaacccgggatacaagatcggatccggatatttctcacgataggaatctttaaatccagctttttgcagcatcacagaacaatcccaattgataatagctccattatgatcccacagatcttttgtattagcctgccagtccagatgggaaggctcgttgaagtcacctcccattatcacagggatccccttgtcgatctccgcttgtgcatcccggataaaagcagagatactctcatcccggtaagccagtcggttcgcctccaaaacaattttctcatccgttaccggagaatctattttatcccagctcataccgctgtatccacgaggcatataacattcataatgcaggtaatccagatggcaggaatagaaagaaacaggttgcccggctatcgtaaccgcagctttcaacattgctctgccttcatcaccagggacaatacaacatttcacgaaactatccggtttgtacttcgtcaaaagaccgacaaccattcccaaagtctccccataataatgcttcccccgcttttccagatcctccaaaatcctgggcatgaacatcttcccgtcgaaatctctgatttcacataaaaaaacgacatcggcatcgacctcatccaatacatcaagaattccctgatagccattcggcactttcgatccttcatgccataaattcatctggtaaacggtaaaggtatcgtttgtcttttctgcttttgcccataccggcatacttaacagacaaaataataagaatattatctttttcatatcatcatctctttattataaaaactatttcaacaaccacatcacgttatttacattatctgtgcctccccattgacgatcgagtgctgcaagatactgttccttattatacaataattcgttctccggatactgccagcgcactgggatcttcgtcttgtcatcgttcaggtttgtattcgggttaatgggaaactccggatacatgttacgacggtaatcgtagtaatcatcatattgcatatgataataacgagcaatatagacttggatccagatctgttttaaacggtctttctgcgtaccttttgtattataaaccacataagagccttttaaataattatcgatgtactcatccgtaatttctcttccattctgatattccgcaggaacagtagaacgaacgaaccgaaaagaagcacggataccatcctcatagtatttttgggcatctccttttatccaaccccgttcgatagcctcagcaatcgtaaaattcatatccgcatatcctaaacgaatatatggaactcctgcataactcaaacggtataccccattcgggcgcgaatgcatcttgttagcaatctttttggactcttccccgaatacggcagcaacatccaatccctgataagcattccagtcactcggttccaacagtttttgtcccggagccagatatagctcatctgtcatggcctgggccggagaaaaataatagaacaaacgataatcctcaaacttcttcaacggatcgatcaatagggcagaaccggcatattcgttaatactcttcacaaaactattatggaacggattctgctggccttgcttatctgaataaacaacctgcaaattatcgtcattgctctggaacaggttaccctccgctactatcctggcaaatgtctcctttatattcaactcgggcgtatcatccacacgcttagacaaagaaatcaacaccttcaaccgcagaacattcgtcgcttttctccacttcaccggatctcctttataaaacggatcaccttcgaatgtattagctgtagcaaagaatttatctgctttttccaggtcggacaaaacacctataaaaacatctttctgactgtcgtaaaccggataacggtactcttctatatccagggcctgcgaataagggatatctcccatactcatcgtacaacgccagaaattccaacctttcataaagtagaataatccggaataggcatctttatcttcctcggaagccagttccatcatttgtttcgcattcgtcagtatccggatataagaaaaactatctgttccgaaacggttgtattgggcattattaatctgttccccccaaaacatcctccgactcagaaactcattatactcccatatcttcgtaaccatgtcctttattacggtggtagccaacatggacgatttaacctgggtggttgcatccgggttcgtattcatttcatcaaaagtcgatgtacaagctgaaaacgaaagaacatacgccagtaaacagctaactatttttatatttttcatatttctcatttgtatactttattagaaatcaactttaatattaaaacccatataacgctgagacggtgcattcaactcttctgtttcaccacctctttccgggtctgcatatttaaaatctttcgcccacagaagcaggttctgaccggtaaaactaacagaagcatttttcatcccgactttcttacaggccgacgacggtatatcataagtcagggagagattccgaagcttaaagaaagtctggctcagcatattctgccagctcgggcttgcatgagagtcatgatacttagtaatataactttcataagataccacgatatcattaggtgcaaaaacccgtgtatcttccaggacattgccatccggatctctttttaccgcaccggaaacaacctttactccttctccgacataagaaatattcccatttacaacttcatcataacggaattggttatctgagtccacatgtgtccctgaattccaaagcatctgatgcgttttagaataagagataccaccgacacgcccgtcaaacgtaaaacttaatgtccaattcttatatcgtaatgtattggttataccccacaccagatcaggaacatatttaccgactttcttctggaacgtctgtcgtacaggaatacctccgttgtgaacaatgtttccgtcagggtcacgttcccagtcattaatagcaatccagtcccagtcggctccttccttgatccagggacgtttcgtggaataatcaggatccaatttatgataagtatagttatcgtgtgaccagttggtcagaatatgccagttgaagtctttcgtttggatgggtgttcctcctactaccagttctacaccggtacgtaaacgctgctctttactattcgtctgaatggatttatatccggtagactcacttacccctccattaataataaaatcagactccaacttatgataataggcaaagtcgatatttaaccgtttctgtaaaaaggtttgagccagaccggcttcccaggtttcggatttctgaggaagaacaattcctccgatcagagcttcaggataggaagctgtagacaaaccatcccaaacatttgttgtaacttcgtatacattattattggcgtatatatctgcgtcttgctttgtggtagtccatgaccctctcactttcaagaaattccaccaggaaggtaacggtaatatttccgacaatattacactacctgccaccgaaggataaaaataagagcgctcgtcggagcgtaaagttgaagaccagtcattacgtccggtaatatccaaataataggtactgttccaggaaacagaagcttttccatagatactgtttacccgtttttgcttcagactgcttgtcgcactaacagggtcggaagatgacttcaacgaataatatccgggaatcgaaagtcctccctgtgttttactcagcatatcatcgtcatgccgatagaaaatattacctccaaacattccatttaagttaaacttgccccaagttttatcggccatcaacatagcgtcggcattgacactaaatttagtatctttatttatactgtaatatcctttcttatcccatgctccgtttgcactgatcgcatttctggattcttcccgcttgttataaatatcagcaccggcacgagccatcgccttcaaccagggagtaatctcataactggtgttgacagaggtattgaacacatcagtatcatacgaagtgatctgttcataagctttaaaccagggattatcataccaactcttatcataccagttctgcatttcattttcttttcctttcacccagtagtctctataatcgcgaacatcatattcggtaccgccccagatcaccatattatagatgtaactgctactataccccgaacctaccgtattcgacgatacacgtttattgtaggccgccgttgcatccatcgaaaatttctgccatttcatttcaccgcctacggagaaagtcattttattcaatttctgattaggatattcccccttatggtaaacttgtgtggcggaagctctgaaagaaccatattttcctttctgggtaacacttacgttgttatttgttaccatactaaactgaaggaagttattgaaattatcttttcctttggaagtaagttccatttctctgaattcgtacgttttcggatcccattgcacggcagtacgtccaatatccaacttatcgccccacaccgaattattattatatttaccacctgtaccggcactgtatgaatgttgtgtttcaggaaaagccagataaccggagaaaaacatagtattactattgacattgatgttcaatccttccttatccgatcctttctttgttgtaatcatgattgcaccgctggaacctcttgctccatacaacgctgaagcggttgctcctttcaatacatcgacagattcaatatcatcggctgcaatttcattgatcgataaatttgcataagggataccatccacaatcaatagaggagtagaaccacgtaatgagatcgttgcatcctgatcaaattcggtattattctgaatattcagtccggcaattttacctgtcaatgaagtagttatatcaacagatttagccatcggcatatcgtcaccactcatcttctggacagagtagcccaatgctttctcttctctcttaatacctaaagcggtaacaaccacttccccgagcgcttgtgaatcctccttcaaatgaacaaccagtgtgcttttattcttaacaggtaaatcctgagtaatataaccgacatacgaaacgaccagaatcgctccttctttcactgtcaatgaaaagttaccatccatatcggtaatcgttccgttgactgttcctttttccataatattcgccccgataataggttctccgttcgcatcggttaccgttcccttcaccgatttagtaaggttaatattcgagttttgaagttcgggctcagtaagtaccacctgagtttctccttttatagcataagaaacaggtatctgctgaacgatctgccccaacacggattcaatactttgatcatttgcttcaacagtaatcggggtactcataccgggaaggcctttcttataaaaaaaacgatatttgcttactttttcaatttgcttcaccacctccgaagcgggtttgtctttcatattgatggttatctgagcgtggatttccaatagtggaaaggttaacaatagtgtcagaataaccatttgtttaaataaatgcttcatgttactcatttttcttttaattagaaataagatgtagataaaataaatgtttgtaactttgtaagcagaagagtcccgttaataacagccggtctcctacatcggctatatcaacttaagggatatctgcaaaaattgtattgacgaggtagctctgtaaagggttacctcttttctttttattccttcctcataggcattctgttagattagacattagatttatttcaatatatggttaacaggccctgttaaggatcccttcttttcaggaatacggtatcacctttattctcatataccacgggagtagtcaggttgatgatgtcgataaagttttcaagactgttattacgaacagttcctatataacattctttctttaacgattcgtcttctatatatatggtcgtattgtacagacggtttatgatacctgcaatctcttccaaggattcaccgtcgaatgtgatttcattctcccgccaaagggctatatccttgaggttattatcttcgtactgcaggaagttgcgggtcaacaggtcgacttttactgattcgtgcggtttgaggatcgctacatggtcttcataactcactcgtacggaaccggaaaacagcgatgcaataattttattatcatttttgtatgaatttatattaaatgcagtccccagagcttccacctgcatacctttggtttccacaacaaaacgtttggccggatttttagcaacttcaaaataagcttcccccaccaatgccacattccgttctttcataccatagtctgccggatagctgatcttcgtatcagagttcaaccacactttcgtactatcaggcaaagtaacgaaagcccgttgtcccttctctgccgataccatgaaattctgtgtcgataattgtttctgcttatgatacatattgtaattgaccaagcttaaaacaacgattatgcaagccaccgcaacccgttgacagattttccaggaaaaacgcgaaagcaacggaatgactttagcttgttttttctcttcatccaaaccacgacttaaccgacgatacatacgttcctgtacatctctgggcatttcatccggactctctttccatgcgctctcgaaaagtttaaaaaactcttcccgggatgcacactgccggaaccattccatcaactgccgattttcttcttcagtagtggaacctgctatcagacggtgaagtaattctattctcattatagattcgtttatatataatagtcttcccaatgtatctactacttagtcgaaagataaaaaacatttgtatttaactttaatttacatactagtcataaatcaaagaatgcatttagaaaagaaatatttgcttttacaaggaaagataaataagaaggaaagccacagccttattacccaacactttacggagttctttcaaagcctggtagatatgggcttctaccgtacgttcagataaagctagtttttctgctatttcggcatgcgacagattttcaaaacggctcatgataaatactttccgacgcatttccgggaatgacgaaatgacattaaaaatatactcccgcaatgaatcggcttcaatggcatcttcttctgaactggatatcagttttatatcattgagctcttcgagcggttgatttttacgaagagcttcttctatgtatttataagctaaattacgggcgataattgaaatataagcttcaaaattaagctcaggttgaatgttctcgcgtttttcccaaatagtcaggaagagttcctgcaccacatcttcagctatatcagaatcattcaataaatatagaacggtattgtatactttcggactataccgccaatagacggaattaaaagcatccctgtccccttccttaagacgatataaaagttcattatccatacttatcgcaatctccctccattaaacataagttcttatgtttcttcctgaaataaagcatcaaagataataattttatccaccaaagaaaaatacaaaacccaagaaacatattacaacccgaagcaacaataagtgtgtcactccgggtcgatatacacttacagtcaattcatacaaacaggcagtaataactcataaaaatcaaaacaaacggacgatcagctcaaaattagaatcacggaaagaagattcccatggcgtcgtatccgtctgttccttccgtgacttgagcatttctgcagctttctctttttcactacggtagatagaggtacaccactctgctatacgatttcccgggaactccgtactccaggaagtaaccatacgactagcctccgactctttacccaactcacgtaaagccaaagcacttaacaggtttccagaatcgaaataagaatgggatgtctgataaccgacaacggcagataacagcgcagatgccttctgcccatctccttgcccggcagccgcctttgcttccagataatcttccagacggctgtcgatcatattatcgtaaggtttacctacacctaagttctccggccattctttcgatgcttctacacttttcatcacttgtttataattcttgctcctcagttgttccatcgcccggtacaaattggcctcacgataaactgcacgtcctgcatatgaaccttcattcggtaacacctgtattctacttaacaaagagatacatggctgatattggcccgtttcacataatgcttttgcatacttcaagccaatataatagttcgaaggatattttttaatatatttctttccgatttcaacagcctgttgccattgattattggagatataatagttgatcaaagtaaatccggtgcgccacgacatctctatctgctctgcctttaacaaatctctcaaccgggattcaccctcttttaaagaagcacgactcagataaaacggtgcataattcgcttcactacacccctcaaacaatgccaatgctttcgctttatcctgattagcccaataaatcaaaccttcataatagctgattttccagtctggccgaatcatctttgcccactccaacgcttttaaagaagtgggacggaaaggatatacggcttccggaaactgagcgtttgccttttctaacgcaaccatacttccggcctcatctccactcttatgcaatagccaagcttttttataacctgcaatcggataattttctgcaaaagagaataaggtcagggcctcttcattacaacctactgcttcataccattctgccaattccatataagtctcaaaaggaagctcgttacgaatcagagatccgaagtctttttcatccattctgttcagcaggtaattctcaaaacgtgccgcatgatacagcggaagatcttccagcaacggatcgataagcgctttggctttctccggctggttcgtcttccgataaaccaccattaaaacatggtcagcacttagattcatacgattgaattctttacttctcaaggcataatgttcagcctttgcccagtttttatcgagcaggaacatttctgctaatttctcataggctgcactacgtactcccggagaataggaagctaccgaaaaaccgtctttggcatccgtatgatttcccaatgccatgttgcataaaccatacagatagttgacatctccatcgtacgtgttaatgcttaatgctgttttacaacgggctagcgcttcgtcataacgtccctgacgataataaagggaagcaagatcagtcagtgcaggcacgaaataaggatctttttcgagggaagcctgtaaaaacgtttctgccttgtcgagtactttctgattcatccattgctctccctgtgtataaagaccatataccgagttccagtcaaaatcggcaggcagttgtttcgggcgactggtgatgttatccgaaggtacttccgaatacaccagcaagtcttcgcctaccacgactttcagtttaccggcggcaacagccttattcaatgggatagaatctttccaggtttccagtacaccgcagttcaacgggatggagttcacttccttttctccttcatacagctttatggttgtagataatttctgcaaaggagagaaatacaacttcagaaaaccgtcttccctcaacacgttaagcgctccgatacggctcgcctttgagactccttttattccttttaccgggaaccagtactcggtccatcgatccgttgcctgcggaccgaatgccgtatgtttataaggagttaagctactgttggaagcaggttggttgtacatgcgacccgattgcagttcgatatactgcccgtcggtatccgtcaataaatcttcccagatacctccctcacgggaaaggccccacaagaaaatcttcattcccagtttctcgtcataaccggcatgatggatggagccgaaatcgttgtcatgccagtaagcaccatagaaatcgttatactttcctactatatgatacgattttgaattgccgaagtcattcttttcataccaggagatatcacgcccctgttcatccagagggaaagaatggagttcgccgccatgtccgatgtagttcgttccaggatagcagaactcggcatttcccgctgccggatagcctgcgttcatccactgatagtaaggctggtcgatggatgaactgttatgccaggtcgttgttgtcgtaaagtaagccttatctttcggcagattcacttccacggtccacagcgtccgggttaccagttcataagaagagacataacaactcacacttccgtccggtttctgccgggtcacatagtcgaccggcgtactggaagtcggtgcatgaccgataataccgaagttgaactcgataccgcctgatgtccacggaccgcgcatggctatatcacggaacttcacgacgtggttattgtagataaactccttaccggtcgttttatctacggctccccatatttttccacctatctcaggaaagagagtcagtttgatataatcattttcaagagagactactttccattgccggtcggttcctttagcagaaaaaccatcaaaacggaaataaggataaaacagatcggagggatctgccaccggatccggatcggagaaaggatacgttttaactgtttgtacattttcggagactgtcgcctgttgctgtgcggacaatggttgcaatagtgcggtggcacaaagaaggagtatactttttttcatggtaatctatttatataaatcaaaacttttaagaagatctataaagacagaaaaggaagttcttctctaatatcccacaaacaggattagaataaagatcttccttttcctttcttttcatagtattcttgatgaagatccaaacaaggttatcatcactctactgctggattgattaggctggaggctattacctttttgataaaaccagcaaccaaccctctttactttttacaggaatcctgtcattcagtttaaaagtagaagcctgctgaaaatcttttacaaacggagcttctaatgaaacggttgcttcattcatacctaaagccttccaatcaaaagtcagataaatacttttttcctgatttgagaagtttccaatcgatatcagaaccttatcagactttacataagccgtagctttcacttccggatccgaagtcctgacaggacaaacttcatcccagtaaccaagcatctttgcatcttctataccaaacgatttccacaaatcccaaaccggagccggtgaatattttccgtaagaatgacgtgcagttgttccgtacaccatacccaagaaacggttaccaccatcctgtaacatctcactcattacaccgaacggaataccggagaaagttacaaaccattcatccgaatgcatttcgttgtacttgaagctctcgccaaaccacaaccgatctacatatgggaaaaagcctgtatactgatttgcggggccaacggaataccatgtattggaatgtaaatctatcaaagcccccggatgatattgattcataatcttccgcatacgcttcatcaccggacggtcgaatgaaacgtcatccatataaattccatccagatcataattctcaaacatccaacgcagcccctccagataatagttgatccagcgggaaaaaccattcaataccaaagctgcatctgaagtctcattaggcatttccgaataccaggctgcccgataatcatcgatcaaatgttcacagtgccaaggtaaaccatatcccggaccagaaacaaatatctcatgtttcaaacttttcagggcatagatctcctgtacataattcgtcaattcacgaatggtataatataatttgacctttcgtccgaactcatgctcgtgtttgataaatccaatcaacgaatctcgtacgataaacggataattaataaccggattcaaaggttttgcatgatgaatattaatgatattcgcaccctcctcggccgctttatcaaatcccgtatgttccgcatgataatagcgttcagaaaaatgcttcgcaggttccaatggtttaagtggtgtaatcaataaggcaaactcgtaactccgaggttgttccgacaaagtatctacacctgtacttgccacaaccttagcactttgccctttagctcctgatatctgaaccgtaccttttccatggttcgaccaagctctgggtgctgctggtttgtagtcattcaacagaggaccatgataactcccccctctatactctacgtgtaaacctgcttttgcatttcccatccaatagctatcccatggaccttcccagttccattgataggagactggccggaagcctccgccaaaacctgtacccatgaaatactccgaagcataacgtgtatagtcggtttccaaacgtacatccttcactaccatatcctgttctgcagaaacttgtaaatcataatggacatatccgtcatactccataaaagcatggttcgtaaaatagataccgtctttagaataagaggacttccaggaaaccaggccatttgcttctttcttcaaaacagcgtccgtcgcatcaaaagaaacagatcctttatttgtaacgataacgaaacggaatggctttgccagaacctgttcgccattgatttggatagaagcaggcaatccgttagatgctatctgtaacgttttatctgtggcctgaattctgtcgccatcaaccttcattgcctgataaggagtaaccggttcgttatcttcaccaatcctggaattcagccatctcaacctagcatgtctccaaagatcaccatctcctttatctgccaggatctctcccttaacagttatctcaaccggaattacttttgaagcaacccctttggctgaaaaatcgacagtcccacgataaaccccggcttttgcatcttcaggaatctgaactccacaccaaagagcctgaatatttccctttggcacatgaatattaaaagtgatcggtttcccatcccagttaataccttcttggttaaagcaagtaatctcttctttagcaatcgtggcagaaccatttgtcaaatcgctgaatgaaagcctgacgtcattcaattcttctcgagctgcccaaactccaatctgccagacataatattcatttcgtaaagcaacacctgcaaatgatccggcaggtccatttttcacccaacgaacaggtagctggtgaggtaaacgaatcggaaaagccctgtcttccggaaacaggatcggagtttccggatgctgtttcaataaactatccgtttcagcgaccgttgcaataattcccattggagtaaaagcatcgaatttagaacggctttcaaaacgaagtacctctgcttcaggcagatctaccgataatgcagacttccaggtatcatccgcctcataaaccggaggcagatagtcattccaaggtttaccataacgggcatctccccatccttttctatatttataaggcaaataataaatataataaagtccttttcccgatacaggctcgaaagtaaccgtaccagactccaaagaaaagtccgacacttctacattcttgatctcctgaccggtctgcgcatcaacaactataatctttttggtttcaggacgtaaatccggacgacgccatggtaatacagccttaacagctgtattaccatttatatcggaaacctgcactactgctctgtgattaccttgcatatcagctctccacatagtatctgctaccgtgaaaggtattccatccggggcaaacggaagatactgattatctccattcagagtttccgtttttggggaacaagacaacaaacataagaacagtcctacatatcctatatattttttcatcgattcatcattgattgtaaattaataacccggattctgatcatccttcaacaatggattcacatctatggcagtagttgggatcggcatcaacatcaaacgatcatcccatttcttatcaattaccacataaccgtttggagcagttgacgggccattcaggtacttattacaatattcgcttccatagcgccttacatcatcgtaacgatgaccttctacagccaactcgacacgtctttcgttacgtaaaaaatcgattgcttcctgtgcacccaaagaaaccggaacatccggcataccgcaacgatcacgcagcagattcaaagcagaacgaacctgatcatcataaccggctgtcattaaatgagcttcggcaaatgtcagcaaaacttcggcataacggatagtcggataatcttcggctgcaccatacggactggcaacataaggattccaggacaccatcttacgataactgaatcctgtccacgattcattaccattcttgttgatcacatccggatcccatttgtaataaaattcaccaacagctgtttcatgccatcccttaaacggaaacatcaacgtcacatacaaacgactgtcacgattcttgaactccttcatataatcataggtcatcagattggaactggtagcaaaagctttataatctcctgcacttagatttttcgcatagttccatatcttatcataattagccttacgagtatctactgaaatcttctccggaagagtctttccatctatattccaataagcatctaccaaatcctgcatcggttcaaaagatgaataaccatgctgaatagacattgacaatggaataaaataagtataacggtattgatcgtaagcatacggatcttccatatattcatgagtcaacacatattccggattagccggtgttgcattcgctccttgccaaagggcctcatagctaaacatacctttcacatatttatccttatcaattcccaatccggcaaaatctatatacaaatccatttctttggcctcctgttcctgggctgcacttaatgacgtcagtttaaataatgaatatttaccactctccattactgctttagccgatttctctgcttctgcataattgccgaaatataaggcagcacgagcacgtagagataaagcggcatagcgcgtcacacgacctgtttcattcatgaaaccaccactataactctccggcaatatagctgcagcctcagccagttccgtcaggatgaaatcacgaacttcttccacagaattacgggtaacagtcggtgcatcataagggagttcgtctgtaacaatagcgactttaccaaaatactgggtcagattcaaataagcaaaagccctgaaaaaacgagcttcagcctttgtcctttctttaagttcttcactcatatcacaaccatcaacacgagctatatatgagttggctgtccggattgcattaaatttataatccccataagtggcagcagtattgataccgttttgctgaaccatctccatattaccttcccatggcttatggctgtgtgcattatccgtacacatttcatcccagatatccagtcccggcatcgattgataacagccgttcaaagcataccaggcatccttttccgtctgccagaaattttcagcagagatctctgccggtggaaccacatccatatcacaagaggttaatacacctgtcaatgcgcaaaatagaactaaactttttatatgtaatttcataaacaattctccttcaattaaaatgatacattcacaccaaacgctaaagatttactacccaaagcacggacagtactactggttgcttccggatcaaaatccttcattttcttgtctgcacgaatagtgaataaattctcaccagtcagatataccttcaaagaagagatacctaaacgggacactacattcttcggaacattataacccaaagtcattgtcttgaaacggaaatagtcggcatcaaacaagtgatagtcattaaatgccctgttataagttgtatgcgggctactagccgtataaattctcggataaatagcatgagggttgggattcgcttcagtccatctgcccatatgatatcttctaggattatcctgaccatggaagaacggatgtacctgataaacttcaaaggccacatctgcaccactgattccttgtccgaagatcgagaattcaaagttcttgtaatttaccgaaaaattgataccataagtaaaatcaggaacttcacaaccaataatcgtacggtcgttatccgtaatttcttcaccccaattcaacttgcgttgaggaataaatttagtatcaccagcattcggagtgaccccaccataagtataataatgtccggcgtcgatatcttcctgtgtatataaaccatcactcttaaaaccgtagaaagaaccgatagattcaccttcacgcaaaatatacttagctacgccatgaccattttccagattcttgataatatcgttcgaagaagataaatcagttatctcattattgtttgttgcaatgtttgcactgatcatataagagacatctcctatcgtattacggtgtgccaatgcaaattcaaacccacgattacgtactttcgctacattttgtgaaggtgcatttgtaatacctgtttccaaaggcacattgtaagccatcagaatgttgctggtatttttgatataataatcagccgtaccgctcaatttaccattccataaatcaaaatccagaccaatatcagtcaaagccaccttttcccagctcaatgagtggttagcaggcttcgtttcttcaatcactttggctggtgagtcaccaaaagagtaataagcgtctacatctgaaatcttacggcttccataattctgaaaataatcataattacctacattattaatattacccaacgttccataagatgctctgagtttcaaattatcaataatgttacgtgtactttccataaaagactcttcgctgattctccagcctgctgaaaatgaagggaaatatccccaacgattatctgcatggaaacgggaagaagcatctgctctaaaatttgcttcaagcatataccgttccattaatgtatagttgatacgaccgaaataagaaaacatcttatattcttgcatactggaaccatttttatataatgaaccggatgttgctcctgcggacagatcgtcaaatgaatcagccgggaagtcctgacgggaagccatcaatgtttcttcctgataatgttcataagatacaccagccaaagctgaaagcgaatggatatcttttgtccaattataactagcagtacctgtataagtcaggaaattattttttttccagtttacctccatcgaattaaccgtattccccgtaccaccgattactgtacctggattcaagaaactgggtacatcatcttttaaactagtgtatgccttgtttttgtattcatacgatttataagtaccctggcctgtgataaccagaccttttatcggctttaaatcgaatgcaagttcatacattgaattttcaatcgtatttttagtccagtcattcgtactgtaggcacgtaacgggttaccaccggcaaacgtaccactggcttcatgacccgactcaactgatccccattcgccgttggactgacgggcaacgaaggtgctcggaacgatcagcatattatcaaacgaaggtgttcctccgtcaatatctttattacgctggatatacttcacacttccgcgaaatgttaaccagccagttacatccgatgatacattcaaattcagattataccgtcgggtatcccgattccggatattctccgtatcatagacataacccaatcctgcaaaataacgtaacttcttagttcctcccgaaaagttcaaagaatgtttggtcgtaacggtccaatcatcgaatactagatccacccaattcgtattcggatacagatcaggatcggttccttttttgaacagctctatatcactatccgaatacccctgatttttccctgcagaaggattcgtattatacaatgcctcattatataattcggcatattcccatgagttgacaaggtcctgtgtataggtcggtgctttcatccccaccataccactgtaagagacttccattcgtccgtccttgccctgctttgttgtaactaagacaacaccataggcagcacgtgaaccatagatagctgaagatgcagcatccttcaggaaagaaatattttcaatactgttcgggtccagattagaaaagaaagttgcatcggcaatagccccatcgattacataaagaggttcggaagttcccaaattaccccgaccacgaaagtttatagaaacatcttttcctggacgggaaataatagttacccccggaaccgttccttgaatggaacttaatacatctgtctgtacgcgatctttgatatcttccgaactgacagaagcaacagaacctgtcagatttactttcttttgtgtaccataaccaactacgacaatttcatcaagcgctttaaagtcttcacttaaagttacgtttatgactgttcttccggcaacattaatctcttgtgtattatagcctatataagaaataactaatttggcatttgcaggaacagttaatgtgaactgaccatccatgttagttacagtcccattggttgcagacttctccagaacatttgcaccaacgatcggttccccattcgaatcttttacaacccctgagatagtaatacctttttgctgattgatattttccaaagctggaacgacttcatcagctttatataaaacaatatgtttatcgctaatcagatattttataccttctttttcaaaaagctggttcaatacttctgtaacagttttgtcttccaccgttatagaaactttacgttgtgtattaatctggttaacattataagtaaaatagaatgcacttttctgttcaataattgaaaggacatcctgcaccgaagagttctctacattcagagagaattttaccgactgcgaataagtcacacttgcagtaatttgcattgtacccaatagtaagaacaacaagatacatctcataataaacaaagtttttcggagccatggcgacttcttattatcgcatgacatgcttttcataataaatttcatacatttgtaaatgattagttagtaataaatttaggttgtctctaatgcgttacttgcttaatccgaaccggggatgtttgcggcatcttcggttcttcatttcttataacatctaagttttcttcataagcatcctcattttaaaggtttataaatttgtatctgatccccctgaattttataatccagtttgcgggtatctttcaataatgtcaatacctgacttattttagccgtttctttaaaacgacaggtaaacaattcggtatcgagttcctggtctttcacaatgatatgaacattgaaacgacgctccaaatcagtcacaatatcaatcaactgctcattcacataagccgcttcaccaaccgtccacgatctgactaaagatgtattgaccgacttattaacagccaagccattttctcttgaataggtaacctgctcattaggtcttaaagtgactttatgctcattatcatttgtagcgacttctacttttccctcagccaacgttattgcagaaggttcttcattgtatacttttacattaaacttagtacctaatacttttacctgaagtaaatcggcatgtacaacaaatgggactttttcgttatgggctacctcaaaaaaaccttcaccttcaagttcaacatcgcggttcttagaagaaaaccgggcaggataagtaaatttactatgagaattcagccagacttttgtaccgtcggataaggtcaaagaaactctttgaccattaggaacttcaaccatattcatagaagatggttcttccttcaatagaaaatacagattagtacttagtaatccaatcaatatgaccgctgcagcatatttcatccaaaatagataaggaccttttcggcctgtctccatttttatatccttttcctgtaatccggacataaaacgagcataggccatttcaatctcttgtttgtcagaaaaacgcagctgatctttcaaactccagatgcgttccatctcaaacaaccaatcggcattagcctgattggcagcaatccatctatcgacttcttctatttcctccggtgtgcaacggtgggttaaaaatcgtattaatatttcctcattcatacatcttccttatcgtttatataaagaagacaactgaagcattcaaaactacgtagtcaaaaatgaaaaaagttcaacttaatttataatccggaaaaagacgatataaagtattagtaaatcttttaaatcttcccgcagaaaaagtactgcagtccggatatggctcgcaactgtgcgtactgatattttaagtttatcagcaatttctttgtgtggcatatcctcataataacacaaacggaatacttccgctgcttttggggataatttttttacagaagcctcaatctgttcacggagatcccaattaattatttgtttcaaaacatcattagaatcagtccgatcattcaggaaagcaatacgagcttccgctattcgtattttagcagtatattcttctataaccatttgatgtttcagataattcaagcaccggttttgaaggactttgaaaagataagattgcacattgtctacatctatttgttgtttttgttcccagtagaatacaaaaatatcctgtaccaaatctctagcggcctgatcatctacaaaacggcaagccaacgacatgagcttcggataaaagtgaacaaaaaatcttttaaaagcttcctgatctccttcttttattctatatacatcaataggccccaagctatgaatttcttaattgtacaataatcctcatcagttataatacgaagttcttgaggaactaatgtctttcttcaatgacaaatataaactatttatattataaatggttaatttgagcgttcgaatccgatgatttcattataaataaagaaagagtctttaaaaaagaatatatatgaggcaataatactttttacatatataactaatttacagctaattgctgttcaataatcaccatagttcctcaagaactcgattctttcatttaaaacaagactcaaaatgaaaaatatcaattctgctaatacaggcacaatccctattaacagtttcaattcttccactattgctaaaaatatttggtaaaaagaagaagtagtttataaaaaaaggtctgaaacatacatttcagaccttttcttctttctgttgtctcacgaggattcgaacctcgacagacagaaccaaaaactgtagtgctaccattacaccatgagacaatccggcgctttatctaaagcgatgcaaaggtaagaataaattcttaccctgcaagcgttttttcttatttttcttactttacgatcagcaggtaatagttcttcttacctctctgaaccaacagatacttttcatccaacagagaagaacaatcgataacagcctctgcatctgcaagtttttccttatttaggcttatacctccactctgtaccagtttacgcatttccccttttgaagcgaaaacagcagccttttccgttaacagatcaatggctttaacaccggcactaagttcttcacggttgatctcaaactggggtacaccatcaaatacagctaataaagtatcttcatccagcttctttaatgcctcagaagtagagttgccaaataagatattagaagcttctacagcagcttcataatcttccaaagagtgaaccatcaccgtgatctctttcgccaaacgtttctgtaaaggacgaagatgagcagcagcagcctgttcttcttccagtgcagctatctcttctttactcaggtctgtgaagattttgatatatctggcagcgtcagcatcacttacattcaaccagaactgatagaacttataaggagaagtataacggcgatccaaccacacgttcccggattcagtcttaccgaatttacctccgtcagctttcgtgatcaatgggcaagtaagagcaaatgcttccccacctgttttacgacggatcaattctgttccggtagtaatattaccccactgatcggaaccacccatctgcaaacgacaaccttcgttctgatacaggaacaaataatcatatccctgtaacaattgataagagaattcagtgaaggacatacctacgcttgattcagagctaagacgtttctttacagaatccttagccatcatataattaacagtcagatgtttaccgatgtcacggataaagttcaggaatgaataatccttcatccagtcataattgtttaccaacttggctgcattaggagcatctgaatcgaaatccaggaacttagccaactgctttttaatactgtcctgattatgacgaagtgttgcttcatccaacagattacgttctgccgacttcattgaagggtctccgatcataccggtggcaccaccgaccagagcgataggacggtgtccggcacgctgcaaatgcttcagcatcattacactaacaaggtgcccgatatgtaatgaatcggccgtcgggtcaatgccaacgtaagcagaagtcatttctttctgtaactgctcttctgttccgggcatcatatcatgaatcatgcccctccatcttaattcttcaacaaaattcatcgttttaattattcattattatatagttaatgcggacaaagatacgactttatgtagacacacaaatcataaagtgaacacaaacgtaacaaaagcgtaacatttattcaacttagaaagctttatcatatggccggaaacaaacggcctaccgtttgattaacctgataacccaactcattaacagagatttggagacctgcagcaagacgttgataaatatcttgtatggaacaggacgattcatctgtttcaatcaacaaacgttccggccaagctttacataaagacgatatctgaaaatgttctccaaaagacagataaaaaccttgtaaaatcaattgctgtgcgagttctccgttaccacgaaagccgtgaatgatccaggggatatgaggtttcactatttttctgacagcaataagttctccccaggcttttacacaatgaataataagtggtttattcaacttttcagccaatacggcttgccttaaaaaaacattcttctgaatatctaaaggcgttttcaccagcttgtcaagtccggcttcaccaatagcgacaatagcagaggaagaagcaaccgattcaaggcaggaaatctgcttatctacattatgtatataccacggatgaataccggcagagcaccattgagcaggcatggataaatcacattcctcccttataatcgtatttacgattgcgatatcctccggatgaaccgagggttgatgagtatgtatatcgtagtaaatcatatttacggcaccggatcatacccgcttccaccccagggatggcatcggagcaatcgtttaacagcgaggtaaagccctttgatcggaccatatttcttcagggcctgcacagcatattcggaacaggtaggtgtatacctgcacgatgccggtgtcataggagaaatacaatatttatagaaataaaccggcaacaggagaagtgtagtaaagaatttcttcattattctttgtcacgcaataccttgattgcttttgccatcgctttttccatatccgcaaaaggatgtatctctttatccagataaaggaaagcaacaagcatacatttatttttttctgccagcggatcgatcagatcatatttacgtacccggtaggcttcacgcacctgacgtttgatcaggtttcgttttacggcacgcttaaattttttcttgggaacgctgatcaggatagagacgggagcagacatctcctcttccagcggtaaataaacaacccgcagtggaaacgctacaaacgattgccctttttcgaataacaggtcaatgtaacgcttccacgacaggcgctcttctttagaaagggtataccttttattttccattctttttatttccacccaactctttcttcagatatagatccaaagcagccgtcattgaaggtgcttcgggagtaggtgcttccacatccaacctgaggccggcatcctttaccgctttcgccgttgtaggaccaaagcaaccgatctttatatcttcctgcttgaagtcggggaagttcttcaataatgaagaaatacctgaaggactgaagaataccagcatatcgtaatcaaatttctcatctttagcaaattcgttacttactgttctatacattacagcctttgtatagttgatcttttttgcatccagcatagcggtcagatcttctttatgcacatcagatacaggcacaagatatttctcctttgcatgctttgcaataacggtaaccaaatcttcaggctttccggtctggccgaaaaagatcttacgctttctatacacgatatacttctgaagataaactgcaatagcttctgtcatacagaaatatttcattgtttccggaatggtgacacgtagttcttcacataaatgaaaaaagtggtcaatagctgtacgagcagtaaaaattactgccgaatagtccagaatagaaattctctgctgtctgaactctttagatgaaagagcttctactttgataaaaggacggaagtcgatttcaaccccatatttctctgcaatgtcgaaatacggagacttctcggatgcaggcttcggttgcgataccaacaactttttgatgttcaatgccatagagtactcgtctcgataaagttatacaaaaaaatcataccttcatacaaaaatataagaggtaaaatttcttgggtgcaaaggtacaaactaatatataataatccgacattattcttgtgaaatatccgtattgtcttataaattattacaaaacgacacaaaaaatagaaaatacaaaacaatataacgggagccaatgttttactacctacgaacaataaccaaagtacaggaatgtataataaaatgccccagctccccattattgcgttataactttttttccagaatctatacttatccggagaggcaaaaacaaatcccaaaagagaattacagaattgcttaaactggaaaaacaggagtagcacacaaaaaataaaaacaattgtaaaaaggacttctttctctcccaggtgactgacagctccctttacccgggcaatagtaaacaatgctatactacacaggaaaagtgcctgaaaaatcataaaatggcgaaagaaagccccacttttccctaccgtttcatcaaacagattctgccgttctttcaaatatgcgacatctttcaacatctttataaaatgctgataattagcacggaatataatcgcgaaagcaaccagcaaggatagcagcaatgaaaatatcacatcatctaccaactgaccgtcccacaaacgaatacccacatatccttcaaacatattcatgcattgcaatttagcactgcaaagatagggaattatataaggctgaacaaaaaatcagcaaaacagaaaatccggatgctttgctgattatagtttcaccttaatgaaacacttgtttctccatggtgaaacagttgtttcattagggtgaaactttttaaaccaagtaattaaacgagcaatgtttctttaataatctcaccaacggtgggatgcgggaaaacgatcgactgcaactccccggctttcattcccttttctattgccaggcctgcaacaacgatcagttcagaagctggattacctaacagatgggcaccgatcaccgtttcatctttggccaggatcaatttacatacaccatttccctgttcgttctctgccacaaaacggccggagaaagccatcggtaatttcttcacgacataagagattccttctgcctgaagttcttcttcagttttgccgacaccagcaatctcgggattagtatatacgacacccggtatcgctttgtaactcatgccggctccggcttttccacagatatgtttaacggcaacttctgcttcacttactgcagtatgggcaagtaaagaaaaggctgtgatatcgccgcaagcatatacgttcggcagggaggtctgcatatattcgttgacttttataccgttccggaaagactcaacacctaacgtctccaatccgaaacctttggttaccgggcggcggcctacactcagcaacactttttcaccactgatgacaaagctttctccgtctttctcaacggtcacttcacctccatgaacggcagttactttatggctcagataaaatttaatacctcttttagcatattcagcctggagcatttcagaaagttctttatccatcggccccagtatcttatccagcatttccaccacatgaacttcagtccccatgctgttaaagaaagaagcgaattccataccgatcactcctccaccgataatgacgagagaagcaggaagctcttttgtctgcaaggcttcacggctagtccaatagtctgtttccgccaaaccgggaataggagggataactgtttccgatcccgtacacagcaataggttagcagcctcatacatttcttctccacaagcaatggagatcgtaccgtcggcagcacgtccttttatctctgcttcaccacttacaacaacgacaccatgttccgtcatcttcatacggataccggcggtcagtttctttacgaccttatttttacgggcgataattttaggaaagtcgaaagccggattttctgcttttaccgcatacttagacgcgtgtttgatcgtatcatatactttagctgaataaagtaaagttttcgttggaacacagccttcgttcagacaaacacctcctaaagcgtttttctcgaaaagtacggtagaaagtccaccggcagccgctctttcagcagcagtataaccggcaggtcctccaccgattatagcaacatcgtatttcatgttatcagatttaattaagtttgatattgtgattctatttatcattctacaatagtccagcattacttttgatctcaatatccggattgaatttcttcagtaactttacaaactctttctcgttttgcggagaaataagcatccacattttaccttctttccagatcacgatcctatctaacgataaggagtaactgaatacaggcagaatagacggttgcaacgcctctatatcagcaatagcgatttcctttttaggaaagaaactacaacgaagcaacaacataccgtctgccgtaaccacatagtaagtattgaaaaacacatgcaacgtcaaagcactggcaaccaaagaagtaacaatcgccgctacattctgatgcagtacggatacgacacacaggattgccaacacaataatcaacagatggtaccaccacccgatcttagatttaaagactctatccattttacgaattttcgcgcaagatagtcatttcttcacttacttgttgtaaagcatccacaaatccttccgtatcgaccggatagacagtgtttctatattctttatccttataaggcttagtgtaatatacgactacactacccgattcttttataaacactttatcgatcgcctcaacaggaatagccacaaaatttccctgagttaaatactttccgtcaatctgataaggcccgatcgcccaaagagccacaatcaagatgattatataagcataccaaggtacctcattcaaatacaacaatccgaaaataataagcaaacaaacagcgatcgacacatgtttcggagtgattacccgttttctaaatgctttcttttccataactttatgtattaagttggtaataagcaatattaagcatttttgtctacataatcaagcagattccattatttttatggtgtaaacaaaaagaaaatacgccgccacttcacagtaacgacgtatccacttaaaccggtcaaacaattccaaaaggaatatcttttttactttacttcttcaagtacagaatatgactgaagaacgttattattattgtattgttcagtacgaacaaccccaatgttaggtgcataccattcataaccgtaaccttcgatcgtttcttttggagaacgtgatttgattttaaattttactttcgtacaatcgaatgtacctgccggagtggtgatctcttctgttttaacatattcacgatcgtaaatagaaatattctttctgtctttccgattcttctttgaataaatgttgattacagcgtcatcgaaatacacatcatccgaagaagcgcctttcgatacgctcggataattgataacggcatcggtagctgccactgcggtattcgttgtagtaacaaaagacggattggtaaggacctctttcatatccataaaaaattcgccatcctggcaaaaagcctccaattcacctttgtcgacaaccgtaccgctgttgtttgtgaatacgtaatcagcttcgacttccagtccgccttgtttattttctacctcatccacaacataagtcattacacctgacaggttgcctttgccatcataactctttttcaccaactttgtaccttttgtagtaggaaaaaagaatgtacaatcttgtgccatagccccgcctgccaacatggaggctaaagctaacagtaaaactttagatttcatttttataacgtttaagtattaataataagccggatatccaatgcgtagttaaaacaggggaagccttcgaatgtttatagcttttcttttaaaaatagcaaaagaataagtatttcgggagtttttaaccgaaaggccgccgggaatggtacaaccataaaagttaattcctaactttggcgctctaaacagtaatgtcttatggtacaaagattcgatttcttagtgataggttccggtattgcaggaatgagtttcgctcttaaagtagccaataaagggaaagtagcccttgtatgcaaaactaatctggaagaagccaacacctatttcgcacagggcggtatcgcctcggtaaccaacctgattgttgacaatttcgacaagcatattgaagatacaatgattgccggcgactggctcagcgaccgcggcgcagtagaaaaagttgtgcgtgatgcccctcagcaaattaaagaactgatcagttggggagttgattttgataaagatgaaaaagggaacttcgacttacatcgcgaaggcggccactccgaatttcgtatcctacaccataaagacaacacaggtgcagaaatacaggacagcttaattcaagccatccagaaacaccccaatatcaccgtatttgaaaatcatttcgccatagaaatactgacacaacaccatctgggtgttaccgtcacccgtcagacaccggatatagagtgttatggtgcctatattatggacccgaacggtcggatcgatactttcctgtctaaagtaacccttatcgcaacaggtggtgtcggtgccgtttatcagacaaccaccaacccgttggtggctaccggtgacggaattgcaatggtttaccgtgccaaagggactgtaaaagatatggaattcgtacaatttcacccaaccgccttgttccatccgggcgaccgcccatctttcctaatcacggaggcaatgcgcggttatggtggtgtgctccgtacgaaagacggcaaagaattcatgcagaaatacgacaaacgcctctcactggctccgcgtgatattgtagcacgtgccataaagaacgaaatggatactcggggggatgatcatgtttatctggatgtcactcacaaagatccggaagaaacaaaaaaacatttcccaaacatttacgaaaaatgtctgagcctgggaattgatattactaaagattatattccggtcgctcctgctgcccattatctttgcggaggtattcaggtcgatctgaatgcccgctcttcaatcgaccgcctatatgctgttggagaatgttcatgtacaggcctgcacggaggaaaccgcctggcatccaactcgctgatcgaagcggttgtttatgcagacgctgctgctaaacactgtctcaatatcatcgactcgttaaaatatcaggagaatatcccggaatggaatgacgaaggtaccacttccctggaagaaatggtattgatcacccagagtgtcaaagaggtgggacagattatgagtacttatgtcggtatcgttcgttccgacctgcgcctgaaacgtgcctgggaccgcctggatatcatctatgaagaaacagaaagcctcttcaaacggtcggttgcctcaaaggatatctgcgaactgcgtaatatgatcaatgtggggtatctgatcatgcgacaggctatcgaacgaaaggaaagccgagggttacattatacgctggattatccgcctattaaaaaggaataaagataaaaagaaggccgcttttcaaaaaataatggcggcctttctcttccatcacttcacacgctctaatttgagtgtccatgtataatggcatggaagttcatcaaaagcgaatacaggcattgttaccagaagatcacgaccttcctgtttccattgtatttctttatcacatcctaacagaatttgattctactttagcaaaatgtgaaaccaaatgacaggttttgtaggggcgaggtttgcccgccctttgcgacaataatataacaaccggtgaagaagggcgggcagaccccgcccctacggtcgaacctgcctgttccattgtgacggcgcctgtaagggcggttcgcgaaccgcccctaccaacgacactacattcaaatctgtcaagaactgaatcaaacaataaattcaaaacagtttctaaatatcactgaaacttatattatccatatcccaatcaaacctcctgaaggatcttttcatctatcaacattatgcaaatgtaatcttttattcctcctgtgacaatatttattataaaatccgatgtcattctgaacacctaataaataacagctgcatttcgtttgttccacagatgagtttctttcataccacaactgtggtatgaaagagaaacggttactagtagcagtacattccgggtaaacagcaacatctgccggataatctgctatatccggaaggtaatggagactataaggcattataccgcgacggcgataccccgaactggttcgtaaaatgcttacggaacgttgttatatcgttatatccgaccatttctgcaacttcctggacagaaaacttccgctgcatgatcaatgaagccgctttactgatacggatgctgcggatcacttctatgatggacaggttactttgctgtttgatcttccggtataaagtcggctggcttatattcaagaatccggcaagagcttttgcgctgaaatcgggattcgtcagattgacttcgatgatgttgataacctgttgcatgaatggatctttcccttcctcttccggctcttctgccgtatgtttcagcatcaatgtctttgtataaatacgtttcagctgctcccgcatatggatcagattctcaacttttgctttgagcacttccgggttgaacggtttcatcacataatcgtccgcacccatccgggtactcttcagcagatcctcctcctcagcctttgccgtaagcatgatgacagggatatgggctgtctgcaaatgttgcctgatctcccgtacacaaacaaatccatccattaccggcatcattatatccgaaacgatcagatcggggatttctgttatggcagtctccactccttcctttccgttatgtgcttccaaaacctgatattccttgctgaataaggtattgatataaccccttatttcatcgttatcctctactatcagaagctttttacccgaattcggttgggaaggttcactctgcttctccacttcaaaataagtatcctttccatccggctcgttcgttttttcaatcaattcatagtgatcatccctgaaatgctcttttccacatgggatataaagagtaaattctgtccctttatccggagaactctccaataaaacattcccgtgatgcatatccatcgtgttttttacgatacgtaaaccgatacccatccgggtagaaaatgagggttcattcttccccgtaataaaagaatcgaagatatgctcctgcaactcttcggcaattccggggccattgtctgcaacagaaagaagacagaactttattccgtcgagttccttttcagacaatgaaacgcttatttttccatggctgggagtatatttgaacgcattcgataaaaggttttttaatgcggattctattttttcacgatctagccagagattgagaaaccggataccagagtccaggatgtactccgtattctttatttcagccatgtgtttaaacgaggccataaccttcttaaccaaagcaacaatatcaacttctgacaaataaagctgcaccattccggcttctattttctgaacatataaaagctggttcaccagggtagataatgaggacgcattattatagataagcgatagcttttcatgtaaagcttgtgaaagacgatccgcctgcaacaactcctgtaaaggtgaaagaattaatgtaagcggtgtccgcaattcatgagagacattggtgaaaaagttctcacgttccttgttaatctgtttttccttctcacgctccagattggcaacaaacagttcatgcttcaaacgttcctctttcctcaagcgggcctgctggatctttacgcggcgcatccagtaatacaggaccaataccacaaaaaacaacacagtcaggcggaaccagaccgtttcataccaatgaggcaagatctttatgacaaaggatgtcacatcaccgctggaaccgtcaggaaagatacttttcacttcaaacagatattcgccttgtggaagattcgtataggataccttctctccctcccccgagatcaaccactccggttgataaggagccaggtggtaactatatttctgcaacgtctccgaataggtcagattgctgaaaagaagagagaagctattattcgtgccggacaatgtcaggtcatggatataaggaactccttcggtaagaatgacctggtcgtttatcttttcccctatttcaacaggtttattatccacctctatccgggttattaccactttatccggaacaggatgttcgtccattacatcctccgatgtaaagtaagtaatgttcttgttattaccccagaacaaatagtcgttataaagcatcaccgagcggttatttcctgatatatagtaattgtaaaatagcttctgatgcttgctgtaacggcagatactggaattggagcctaaccagagatgtcctttcatatcttcgctgatacaaccgataaaattgctactcaaaccgtcatgtgttgtatagaaggtatcgatccggccggaatttgtattcaggacaccaaacccatccgtatatccgatataaaggttcttatcggaagaagcgaaaagagagcgtatctcacgtgccggaatagtagcctccttttcaaagtcaccctgcaagcttttttctttcagattgaatttcttaagtccggacgtagtaccgagccataagtttttatccgtcgtttccgctattgtccggatcgtaccggggcagatctcataccgtataaatagtccggagattttatcgaatagcaataatccatccgacgtccccagccataaacgatccagactgtcaaagaacagggaccatacagaaccattccacgccggggtatcagacaaacgtatcgggtagataacgaatgttttatcggccgaatgataacggatcagttcagagtttgtatttccgaaccagatatcaccgtccttatcggctgccgtactcagtacagtattcccggcattgttcgaaaccagttcaaaagacaatcggtgttgcggatcaaaggcttccgtactcctcataatacccttgtggaacgtcgccaaccagatatgattgtccttatcggtagtcatcgcacatatttcattatgcgtgtcttgatgaaaacgctgatagaactgctttctcagatcggaagaatatacaccacctccctgcgttccgatccagaggagtccatccgaatcgtaataagccgagatcatgcgggtttccagattgcggtgaagctgtgaggccgtattattataaacttccgtagaatattgggtagagtcttctttatccggtatcaggatagcatacccattccaggtagctgtcaggtagcgtccgttactaagcggaacgatctcatagacatcccagtgagataaggaattcttcttgttcttagggtcatacgtgtattgcgaataagtatctgaaaccggattataccggatagccccgttcgcccaggtagagatccagatataaccctctgaatatagcaggcggtgaatatgtattttctccactttgggaagatctcccttatgcaggatcgtataagtggcaggatcaaaagcgagaatattcccccagtccgttccgatatatataattccgtccggtgactggcaaaaagccagtaaatttgtcttttcattaaccagtgaagcaaactccatttctactttgaggtttactccctcgatatttcctgctttgcttttcacataatctattgaaaccagcgaaagattatcataagagagtgaccagaaagaagagtcgttttgaattagtacatcctggactctggtatcccgatccctctttccggtatactgaacagggatgaaccgttccagcctccggtcaaaacaatagatctgctgattggctaccagccaaaggataccgttaggtgtttcacgtacctgcgatacttttacataactattatcaggtccgaagttctttatatttttcccgtcataacgactcagcccgttatccgtaccgaaccacataaaaccgttgctgtctttatggatacaggaaacggtattatcagccaatccgttctgcatagtaagtacccgaatgtctttctcaaaaaaagcatatccggaagtatgacagaaggcaaacaataataacgcaacgataaatctccccatacataaaacgataagtcatacaaagaaagaaaaaaagaaggagaatactcctgatcggagcaaataaaacagatgaaaaagaataattgattaaaacaccagttgtttatgaacaaatcacccactatactgtatatcaagaagtaaatataagaaaacacctgctgttaatgaataaaatgcctgttacctcttctttatatagcaaatacttttgctcatcaaagattatttaaaatttagtattcacaaccttaaaactaaaaaaggatgaagaaaagagtcacattattaattgcgctgctgatggccagtatatcctatatatacgcacagcagttgaccattactggtactgttatagacaaaggtctgggcgatccggttatcggagcaaccatcctggtacaagggaccaccaatggaactgttaccgatatggacggtaagttttccatagaagcttcaaaaggagatatattgcatatttcctatatcggttatcaaccgcaaactatcaaaatagacggcgtacagaaagtctttaccatccaattgggtgaagatacacaggcactggacgaagtagtggttgtcggtttcggtacacagaagaaagtaaacctgacgggagccgtttccaccgtcgataccaaagcattggagtcacggccggtcgcccaagtgggacaagccctgcaaggtgttgttcccggtttgaacctttcactgaacaatcagggaggtgctctaggtaatgcactgaaagtaaacatccgcggtacaggtacgatcggcgaaggttcgaatgatgctccattgatccttatcgacggtatcgagggagatatgaatgctttgaacccggatgatatcgaaaacatctcggtactgaaagatgcagccgcatccagtatttacggttcacgcgccccgttcggagtcatccttatcacgacgaaaagtggaaagagcggaaagacacaggttacctataataacagtttccgctggtctaccgccaccaatcttccagatatgatggattcctatacatttgctaaatattttaatgcagctgcactgaacagcggtcaggatactccgttcaatgacgaaacattaggacgtatcattgcttatcaaaaaggagaaatttcgacaacaaccgtaccaaatccaggcaatggaatgtatgaattccaccaaagagcgaacgacaatcagaattggacacgcaaccatttcaaaacaggtttcagccacgaacataacgtaaacgtaagcggcggtactgagaaactgacctatttcatgtcgggtgccttcatgaatcaggccggtaatatgcgttacggcgatgacgacttcaaacgtatgaacgcatcagccaagattaactcgaaagtaaacgactggttacagattggtttgagtacccgttttatccgtgaagagctggaccgtccgacctatgctaacgacgatccggataatacggcaaacggtatcagtgtaggtttatattatcacgacatctcacgtacttggccgactatgcctttccaggatccgaacggccattacatgcgtaactccaaaatcatccagatagaagacggaggacgttacaaacgcagaaaagacatcatctatacacaagctaacgtaactattactccactgaaagactggaacatccgcggagacgtaagtctgaaagcagaacatataaacaaagacgaaaacctggctaaaatctatgaatggaactcaaaaaacgaaccggtgcctctggcgtttgccggtagctacggtcctggtgcgacgtatgcatggtcttccgcacaggacaacaatttactgacaaccagcttgtataccgattacttcaagtcgttcaacaaaaacaacttcaaggtaatggtcggtttcaacaccgaactctacaagcagaactatgtgtatgctaaacgcgacgatgtgatcagcgacgaagtaccgagtatcgacaccagcatgggtaaggactatacatctgccaacaaaaaggaatgggctactgccggtttcttcggacgtttgaactacgactacgacggtcgttacctggctgaaatcaacattcgttatgacggttcttcacgcttcctgcgcgacaaacgctggaatgtattcccttccttctctttggggtacaacatcgcacgtgaagcattctgggaagacctgtcggaatatgtaggtactttgaaaccccgcttctcatggggtaaactaggtaaccagaacaccaaggaattctatccgttctatccagcacagcccctgggactgaaagacggtaaatggttaatcggcggacaacaaccgactacagctactgctccgctgatggtcagcgacctaatgacctgggaaaagatcacaacaaccaacatcggttttgactttggtgccctgaacaaccgcctgaccggttcatttgaatggtatacgagaaagacagacgacatggttggtcctcctgaagaaaaatcgccgattatcggtatcgataacgacaagttgccgcgtattaacaacgcagccatgcaaagcaaaggatgggagctggctttgacctggaacgaccaaatcggcaaggtaggctatacagtcggatttacattggcagatgccagaaccaagatcaccaaatacccgaatgacgcacagatcatcgaccgcaaaaactcagacgggaatatggaatacgttccttacaacggcagatacatgggggacatctggggatttgaaaccatcggcattgccaaaactgacaaggaaatgcaggatcacctggctacaacagaccagtcacagatcggcagcaaatggggggcaggcgatatcatgtacaaggatatcaacaacgacggtaagatcacaaccggctccaatacggtaggtgatccgggcgaccgcaagatcatcggtaacgaaactccccgctaccaagtaggtatcacactgggagccgactggaacggtttcgacttccgcgccttcttccaaggtgtctgcaaacgcgatatctggctggacgggaacttcttctggggagcagtagacggcggcctgtggcaatcgatcggatataaagagcatttcgactatttccgtccgtccggcgacgagatgggagcgaacctgaacgcttatttcccgaaaccctacttcgatgggaatgcgacaaagaaccataagacccaatcgggttatctgcaaagcgccgcctatctgcgtctgaagaaccttcaaatcggttataccgtacctaactacctgacatcaaaagcaggtttgagcaaggttcgcgtattcttctccggtgataatctgtttaccatctcttccatcttcggcgtattcgatcctgaagcagtaggcggagcaatgggtgccggtaagatctatccgctttcaagaacactgtcatgcggagtaaatgtttcattttaataattaaaagcatcatgaaaagacaatcaatcattatattatcgttggcagtcggttcgctgagtttcactgcgtgtaacgacttcctcgaccgcgaaccgctatcgtccgttacttcggatcactatctgaacacagaagccgagttagccagtttcggagctgcccagtacagcgaattaccatcacataaaccgggtgaatacagcatcggtgtcttcaaaacagacaacaacagcgataaccaatgcgctacaaccgaagaagacaacttcgtacctggtgaacgccgcgtaccgaccagcggagaatgggacttcaagaaaatacgcgactgtaactatttccttgaaaccgtattacctaaatatgaagaaggtaagattgccggcctggatgaaaatatccgtcactatatcggcgaaatgtatttcttccgtgccttccagtacttcacatttatgaagaaatacggcgacttcccgatcgtagacaaagcgctctcggatgactatgtcgaactggccgaagccaaccagcgccgccctcagaacgaagtggcacgcttcatcctcgccgatctggataaggctaccgatatgttgaaggaaacacctcccgaagctaatcgtctgacaaaatacgcagctcttctattgaaatcgagagtagctttatatgaaggaacctggctgaaatatcacgcaggaaccgaccgcgtaccgggtggaccgggatggccgggtgccaacgccagttacctgaacggttttagcatcaacctggacagcgaagtacagttcttcctgactgaagccaagaaggctgcagaacaggtagcagacaagttcccattgggagattactccagcatgttcaacagcatcgatctttcagacaaacccgaagtcattctttggagaaaatatgacatcggattgaaaatattccattatgtggtatcctatctgcaagccgtttaccctggtggcaacggatgcggtaataccggctttacccgttcgctggtagaaagttatctgatgaaaaacggtctgccgatctatgcagccggttccggttataaaggagacaaaacactgacagatgtggctaccaaccgcgacaaccgcctgcgtgaatcaatgagtatcactggtgaccagatcaacccgagcaatatattcagtcgtccaggtatcacgattatcgccgaaaataagaatacaaccggctattgcttgcgtaaaggtttgaatcaagacccgaatatgggagcaacattgcctagcaacaccggttgtgtaatcttccgtgcagccgaagcttacctgaattatatggaagctcattatgtattgaacaattcgttggatgccaagagtatcgcttattggaaagccttgcgtaaccgtgccggcgtagacgacgatatccagaaaacgattgcagcaaccgatctttccaaagaaaacgacttcgccgtatattccggtgaacagcaggtggatgctaccttatataacatccgtcgcgaacgtcgttcggaatttatcgccgaaggtctgcgtcttgacgacctgtatcgctggagagcgctcgaccggatgaaagattaccaggtagaaggtttcaacctttgggacgaacaatacaaactgtatgacgacctgaaagtggaaggcgaaaccgacgaaccgaacgtttcgagcagtaagtcgagcaagtatctccgcccgtaccagatacaccgcaacaacaaggcattcaacggatatactttcatgaaagctcattacctggctcctatcgcttacgacgtgatccgcctgagtacaccggaaaaaggtggcgatataagcaccgcttacatctaccagaacccgggttgggaagtccaggcgggaacaagtgccatgaaataaatcaagtcctatcgcttgcgaagtcacaaacaacatctaaatttgacttcgcaagcgataaaaaatagctcatgagggatcgaattcgagttcaaaagcgatccgactccctcggcaacccggaaaatcggtcctgcaaacagtttataatacccgaaaagaatatgaaaatacaatctgaatacttgctgttgatagctaccggccttttagcctgtccgaaccgggtagaggcacaggtaaaaacggacgctcccaatctcgtcttcatcatggccgaccaatggcgcggccaggcaatcggttatctgggtgtagaacccgtacagactcccaatctggataaactcgccgccgaaggcatacattttacggatgctatcagcagctatcccgtatcttcgcccgcccgtggaatgctgatgacgggcagatatccgatcggcagcaaggttacgggtaactgtaattcggataatacaccttatcatgtcgaactacccgcctcggcacgttgctggtcagacgtcctgaaagaccagggatatgaattgggttacatcgggaaatggcatctggatgccccttaccaaccttacatcgaaacaaataacaacaaaggaaaaatagcctggaacgaatggtgccccaaagaacgccgccacggtttcagccattggatcgcctacggcacctacgattatcacctgaagcctatgtactggaatacggatgccggccgcgaagaattttatttcgtcgaccaatgggggccggaatatgaagccgaccgggccatcgactatatcgccaatcaagataataaactccgcgacggagataagcccttcgctctggtcgtctccatgaacccgcctcacaccgattacaacctggttcccgacaaatacaaagaggtataccggaatgtagatgtcgaatcattgtgccactctcccatcatcgcaccgaaaggaacggaatacggtgatttctaccggaagagcgtattggattattatgcctgcatgaccggcgtagacgaccaggtaggccgcattatccatgcactgaaagagcgtggcctcttcgacaataccattgtggtattcacctccgatcatggcgacagcatggggatgcacgatcatatcggaaagaatatttactacgaggaagccatgcgcgtcccgatgatacttacctggccggagaagatcgcaccacgccgcgactcgacactgatgatcggttttgccgacctctatccttcgctattgtcgttaatggggttcaaggaagagatacctgccgaagtggagacgttcgatctgtctgcttccatcctttcccccgacaaggcccgggaggtaatacagccttattatcaagtctcctctgaaaatttaacgactggttacagaggtttccggacaaaaaaatatacatttgcggtacatgctacaaacggccggactgacgaatggatactgttcgaccgtgaacaggaccccttccagctaaacaacatcgcccccgatcagccggaattgattaaacagttttccagccagctgaaagactggttgaagaagacaaacgatccttttataaactgtctgtaaataatatacacatgaaagcacatttttacctggcaatcttattgatagtaagttttctcccggcaatgggacaacaaacgaagatcccccgtccggcacctcaccagttgaagtggcacgaatcggaaatgggcgtcgtcttccattatgacctccatgtcttcgatggcattaaatacggtcagggtaataaccgcgtccagccgatagaagattataatatcttcaacccgacccggctgaataccgatcaatgggtacaggccgccaaagcggcaggagccaagttcgccgtactgaccgcaacacacgaaacgggtttcgccatttaccagagcgatgtcaacccctattgcctgaaagcgttgaaatggcgcgacggcaaaggagatatcatccgcgacttcgtcaattcatgtagaaaatacgatataatgcccggcatctatgtcggcatccgatggaattcactttttggcgttcataatttcaaggtgcagggagaaggagagtttgccgccaaccgtcaacaatggtataaacatttctgcgagcgcatggtggaagaactctgcagccgctacggagatttgtttatgatctggtttgacggtggcgcagacgatccgaaaggcgacggaccggatgtattgccaatcgtcagcaagtaccagccggaatgccttttctatcataatgtagaccgggcggatttccgctggggcggttccgagtcgggtacggtcggttatccctgctggtcctctttcccctacccttactcacacagtaacaacacggaaggaagtcgcaaccataacgatctattgaaacatggcgaccaggatggtaaatactgggtcccggctatggcagacactccgctacgtggcatgaacggacgtcacgaatggttctgggagccggacgacgagaataccgtctatccggtagacagcctgatgaacatgtattacaagtcggtcggaaggaatgctacattgatcgtcggactgactcccgatacgaccggactgatccctaccggcgatgtgcaacggctgaaagaatggggcgacgagatcaaccgccgcttctcctctcccattgcctctgcatcgggacaaaagaaaagcctgacactgaaactggataaaccacaagcagtcaaccattgcattatccaggagaatatcgctaatggcgaacgtatccgccggtataaagtggaagccaaagtaaacggtaaatggcaaaccgtctgcgagggtgagtcggtcggacataaacgtatcgaacaattcccggcagtcgaagcatcggctctgcgcctgacggtctctcaatcggtagcacaaccggatatacgcaacttcagtgtttataacgttgaataaatgagaagatgaggaaacataaaacatatcttttttcactgttgctggggagtgctgtatggttatctcctcccgtcttggggcagacatcgtttgtctacgagaaagggaaaatattcaatgatataataacctttcaaatgactaaggctgtcagcctggcaaaattacaggcacctgtattctatgaacaggcagttcccgacgggcagcaaaccctatcctacaaaatagagatcccggaatataaacaaggcatcttcttcagccgcgatttccgtcccggcgactatcagtggcccaacaataccaaccggttattgccctgggtattcacccgcctggaagacctgacaaaagatacttatccgagcattccttcaaacggaacgccttccgtattgggagatgccttattactggagctgaccgacgggcaattcttatataccaaagcggtagccggagataacagcatcagttggttccagataaataaagacagttcgctcaccgtctgtctctctacattaggaacagatagactcagtccgcaagctcccgtcctgttagtacaaaaaggggaaacggcttatgacgctatccgcaaagcatatacaacattaacaggcaataaggagatctcggcattacaaaaaaggtcggacaaagactacttcgaagccttcaagtatctgggctggtgttcgtgggagcactaccactttgacatcgacgaaacaaaaatgctgaacgacctggacggtatcgaagcgtccggcctccctatccgctatgtcctgatagacgacggacacctggctaataagaaccgccagcttaccagcttcgttccggataaagagagattccctgacggatggaaaaacatcatggcccggaaaaaggagaataaagtaaaatggatgggattatggtataacttctgcggttactggatgggaatatcaccggaaaacgacttcccggaaaagatcaaacaatcgctttacctctataacggcagcatgcttcccggaaaagagaaggagaatatcggggcattctaccaatattatgtcaggacattgaaagactatggtttcgatttccttaaaatagataaccagtcgttcctgttgcccctttacatgggaaatacggaagttatacgtcaggccaaagcgtgtaacctggcattggaagagcaaacgcacaaccagcaggtcggcctgatgaactgtatggcacagaatatcctgaacatcgaccatacattgtatagtagtgtaacccgtgtcagcatcgattacaaaaaatatgacgagaacatggcaaaatctcatctgttccagtcttataccaacacgttattgcaagggcagaccgtatggcccgaccatgatatgttccattcctgcgataccgtctgcggaagcctgatggcccggtcgaaagccctgtccggtggtccggtttatctgtcagactctcccgctgattttatcaaagaaaacatattaccactgatcgatgaggaaggaaagctgttccgtcccgaggctccagccatcccgacacccgaatcggttatcacaaacccgctgcaggatggtaaagcttaccgggtatttgcccctaccggtgatgaagccgtatcgctgatatgctataacctgaacacctctccccagtatcataacgtgcaagctatgatcagtaaagccgattatctgctgcgtgagacgatgacggagaaagcaagccccaaagatcagcggattatcctttatgactgggctaaacaggctgccaccgaactgactacggataaacaaatcatattggaaggtttcactgaccaattatatcatctttgccctgttgctaacggttgggcagtcatcggtgtacaggaaaaattcctttcgccgtcgacagtccgcatccttacccgtaatgataaacaactcactctggatgttctctgtccgggcaccgttaaagtatgggtagaatcaggaaataaacgggaactacggagcatcccggtatctgctccgggcagaataacaatcaacaaataacattcaaaagatacgaatatgaacaagagactattcttttccctggctgcaattcccttactgggaacgacaggacaagccgaagcggcaaccccgcaggaccggccgaatattattctctttttagtagatgatatgggctggcaggatacttcccttcccttctggaaggaaaagacacattacaacgaagtatacgaaacacccaatatggaacgtctcgcccgtcagggtatgatgtttacccaggcttatgcttccagtatcagttcgccgagccgttgcagcctctacaccggtatgaatgccggccgtcaccgggtaacgaactggacctatccgaagaatgcctccaccgaccgtaaaagcgatgtactggaattgccggactggaatgtgaacggtatctgcgaagttcccggtatcgaacatacctaccaggttacttctatggcccaaatactgaaagataacggctatcataccatccattgcgggaaggcccattggggagctctcgatacaccgggagagaacccctatcattttggctttgaagtgaatattgcaggacatgccggtggcggactggcaagctatctgggagaagccaatttcggtaaccggacagacgggaagccgagtccctggtttgctgttccgggactggatgagtattggggaaaagatattttcattacggaagccttaacccagaaagccatgaaagcgttggataaggcacaacaatacgaccagccgttcttcctgtatatgtcgcattatgccatccacgtcccgatcgacaaggatatgcgtttctaccagaagtatatcgacaagggattgggagagaaagaggccgcttatgctgccctgatcgagggaatggacaagagcctgggagatatcatggattacctggagaagaataacctggcagataataccatcatccttttcatgtcggataacggcggacttgctgccgaaccggaatggcgtgacggtgttcctcatacccagaactccccgctgaacagcggtaaaggttccgcctatgaaggtggtgtccgcgaaccgatgatcgtcagctggccgggaaaagtacagccgcaaaccaagacagataaatacctcatcatcgaagatttcttccctaccatcctcgaaatggcaggcataaagaaatacaaaacgatccagcctgtcgacggtgtcagcttcatgccgttactgaccaacaccggtgatccttcgaagggccgcagcctctactggaacttcccgaatctttggggaaacaccggcccgggtatcggggcaacctgcacgatccgccagggggattggaaactgatctattattacgagaccggaaagaaggaattgttcaacattcccgacgatataggagaaaagaatgatctatccgctacccatcccaaactggtaaagaaactatccaaagacctgggcaagcaattacgaaaaatggaggcacagcgcccatcgttcaaggcgacaggaaagccttgcccctggccggatgagatataaatattaacgaggatcaccactctctttcaataatatgtcttataaaagaaggtgctgtaaatataattttacaacaccttcttcctttttatacaaacttctcccttctctgtaaattcagcaatcctatcatcatccagacgattcctccgataaaaaggaaaatacggcttttaatgataagtccttcccatatcaccggaagaaagttttccgggactttaaatgggttcaataggatattccagaaggaacgttctattatatccatttcactggttatcaacagaaggattgccaggattatcgtgagtaccgctgtcccattgccactacgggtaatggtagatagcataaaggccagatttccgaaaaagactaatggaaacattaactgaatggacatttcaaacggattaaccggataaagcaataaggtcgccacataggagaaggccacaaggataaagaagatagccacataaatcatcaggaggcgcactccccacaccttgtacttatagtcagggataccgaacaatatctccagtatacggttgtcctcatcgttctggataccgaaaacggccggataaaaaacaagtaacacacaggggaacatcaacaggttataaataagcccctcgttgatctccgcccgattccaggcagcctgaaacatgaagtaagcaaagaagacaaaggctgccaacaggaaccagatgaacttcccggcaaagatgatcttcaggttatatttaactactttaggtagtaattgtatgagttgtttcgtcgtcatatcagttattcatattctttaataaacagagataagcatcttccaggtttggctccacctgtacggcaccttcataaggcaatacgatagagagataacgcacctggatcgtatcgccatcctggatatgatgtatcaccattgtcttatccagtactttctcgaattcatcacgcccgatatggaactgccataccttaccggcagccatatccaccatatttatcgggtcaccgaaatacttcagatcacccttattgatcaccactacctgactgcaggaactggatatatcttcaatgatatgggtagagaaaataacgatacggtcgcggctcagttcgaccagcagattacggaaacggatacgttcgcgcggatcgagcccggccgtaggttcatctaccacaaggatacgcggcaaatggagcaagataagggcaataccgatacgctgtttcataccaccggagaaagaaccgatcttgtcgtccttccgttcatacatatggacagctttcaagacatattccaggcgttcattcctcacctcgttatccgtaatacctttcaatatcgcctgataatcgagaaattcccaggaagacatattctcgtaggtaccgaactcttgtggaaggaatccgataaggctttgcaattcttcccggtagatacgggtatccaggccattgatccaaatgcttccgtagctctgctccagaataccgcagatcacacgcatcaaggtggatttaccggctccgttaggtcccagcaaaccgaacatccctgtgcggatctcgaaagagactccacgcaaagccttgaacggcttccgttgtttcccgatcagcgggatacttttcaccatgcggaaccacgaacggcgcagaccggccagacgtcctttgatacgctcaatattgacctctttctcatacagatattgggaagagatataaacggctatacagaacacccatatcaatccgactacaccgaccaggttcgtattatccatcttccggaataagacgaacaggattaccggagggatactccagaagatgatacggtttatatacttcacagccttactctccgcaaaacggaagtagagatattcccggactttccgccacaggtaaagggcggtcgcataaatggcaaacgacaacaggaatatccaaagcttgttactgataaagaaccaggtgaaccagataccgaaaagcaacatgccgaactgccagatcacattcacaaaatccttcagggaatggtactcattactcaatcccaaatgccggcgaatatacagaccgctattccattggcgactgatacgccccggccaatcgtatatcttcaccagattacgaacagagatatgaatctcctctccgggatcgatcactttcgagcgtgcccgccgcaaactggtttgtgcaaaataagtcactcccggaataccgaaaacaaggattagcagataaatggcctgccacaacatgccatcggcatacagccagatacaggctagtcccagaagaaacaatacaagatggagtatccatattttaggagacaaaccacgataccattgcaatgtattttccaaccccatacaaacggtcgggatcaggatcaatgtaagcaaggctgagaaagccaaacctcctatgaccgtaatggcaaacggcgcaccgatcgctccggcatattccgaatcgcccatcgccaacggaaacatggcaacgatcgtagtgatcgaagtaatcaggatcgggcggatacgcgacaggccggctgtcatcagggcccggttgcggcgatacccttgcttacggaggatattggagtagtcgatcaggataataccgttgtttaccacgactcccaacaagataaggaatccggtcaaggtattggcattcaataggctgttatttgtcaataataaggccaataaggaaccgatagctgccaacggaatggagaagagcaggacaaaaggcgtcaccaacgattcgaacacagaagccagtatcataaagatcaagacaaaggctgccaggataaggaacttaaaatcggcaaactcgtcttcttcgtgaaagacctctacggccactccggcaggcaggttataacctgccaccaaccggtcgatatccgagcgataaccttccagcaagtctttggacgactccacgtccttagagaaattatagaacacctcgatctgcttatcctggttgacacgcataatacgcgaccgtccccgcccataattgatagaagccagatcctggaggttatgcaatcctccggcggcattttctatctgcacggcacgcaggtcgtcgactgtcttttctttcttctttgattcctcgccgtccgtttcctcttcggggacatcgttgcgaatgataatatcatacgtatcttcgccgatcttgaacgaggagccggaagagaactccgaattgagtgccgtcagtccggtggagatattggcacgggatatatcatacgaggtcagcaagacaggatcgaaatcaagccgtatctccggctgacgacggttgtaggatacattggaattgcggataaactcctgttcatcgagataataacggaagtcttcagccaccagttgcatcacgtcgaagtcggaaccttttatcacaatgcgttcacggttgtcgccgatacccaacaggcgcataaagctacccaggccactcatagcggaactaccgccaccgactccgccaccgcccatcgcttcggccacggatatttcggcaccctggatattggccagtttcgattgcacatcggctttgatatcggctatctgacgttttccgatcttccggtagtctgcctttaagactaaagtaaggacggcatctgtctcacggatacgacagatcagatcttgcttctcaggaaagtctgccagccgttcttccattacctttacgactttgtcggtattgtcgagcgtgctgcccgtttgcatggtggcatagatgttgaaacggtcggaatcgacatctttcatctgctggacattcagggtgatggagaggatgagggtgacgaaaagaaggatgatcgcaccgaatatcacagctcccggattacgcatacaggtcttgagagcaaccaggtagatctgtacgggacgctggctaatggatactttttcgtagaagacagtgtccttctttgggaacacggacgacacggaccacgcggatttccgcggaaagagacttcttatactaaatccgtgcgagtccgcgtgttccgtgttccttctttggagcaaggtgtaagtcgccatcgggataaacaacagggcaacaaacagcgagatagtaagcgtggagatgatcgaaacaccgatatgatgtccgatcagcttgatcataaagttatcggaaaagacaaagggcaggaagaccgtcaccgtggtcagcgttgccgccacaatagagcgccaaacctcccgcgtcccctgcgtcacggaacgttcgggcgtagcgccggaagcggagaggcggtagatattctccaataccaccacactgttatcgagcagcatcccgatagccagcgccatgccgaccaatgtcaggctgtttatcgttatcccgaaagcatagaagaaattgaatgccgtatagacggagatcgggatcgagagggcgataaagaacaccagtcgcaggttcttcaggaaaagccagaggatcaatatagccaacagacctcctacaagtgccaggttgatgatctggttgatattattctccatcgtctcggccgtattctcctgcaccaccacttgcacgtcgagatattccagtttccggttcagcttttcgattgcttcggtagcccggtgcgacaggtcgatcaggtttgcctgcgagtcgttcatcagggcaaccgacacggcatctttcccgttcacgcggctgaaagagttttcttctttcaagtcgaagaagacggttccgacatctttcaacaggacagggccgggggccacgacaatgttctcgagatcgcccacctgggtataaagcgaattgagatggatgaaatacttgctgtcgggctcgtctacaaagcccacgaaggccttatcctgcgtattctgcgtcaggaggctgcttattttagaaggagtaaggtccaacgcccggcacgcctccgggttgaggcgtatctcgatggctttctcccttccgccgtagatattgacagaggccaccccgtcgacattctccaggtcggtacggatctctttatccacgatattacgtacacggtcgataccgcccgagccacgcacctgaagcaccataaagttatttgccaactgcgaaacatccaccttctgcaattgcacagtgaagccgtcggggaaagtggctgccacctcattgatcttctcctgcaggcgcagggaggtgatcttgaagttgaccgtgttcttaaagtccacctgtatactggactgccggctgtcgatcgtcgattgtatcttatccacccctccgatcgaactgatggcgccttccagcgggatgatcacctccgattccacatacgaagggtccatatcctggccggaagagacctggacgaagagcatcggcagttcggcattgggcaataactccaccggaagctgtcggtacgacacataacccaacagggacagtgctatgaacagcatcgagatcgttattcttctatgtagtaaaaagttcatatcactcacattttatttttcatctgctcttcatcctttccaatacataataaacgcatggtatcaccatcagactcatcaaagtagacgtcaccaaccctccgatcacggcaatggccatcggcgagcgcagcgaagcaccttccccgaagctaaacgtcatcgggagcagcgccaggatggtcgtcagcgtggtcatgatgatcgggcggatacgttgctgcccggcctctacgatagcatcggtcagcggggcgccgtcggctttcaactggttgatacggtctaccaggatgatcgaattgtttacagcgatacccaccagcatcacgataccgatcacacccatcatattaatggtcgttccggtgatgaagaaaagcaggatggctcccaccaccgccaacggaatggtcaacaggatcgtgaagggatgcaacagcgattcgaactgggatgccaacaccatataaaccagaatgacggacaaggcaagggcaaacaacaggctgtcgatcgactcctgccgtttttcctcctctcccgtcacggtgatggaataattggcgggaagttcaatgccaggtaccgaccggcggatctcttccgccactttgtccagcgaccggccggcatccatgttcgccatcacccggctgatgcggttctgaccccggcggtatatttctttcggggcctgcgactcgccgaaggtagcgatctcccgcaggcggaattcctgttccccgttctttatcaccaggtcgcccagcgcataaagaggaatatcgggcgtcttaataatgatatcgcgcatctcaccacggtattccatctttccggcatccttgccgccgagctgttgcttgagttgttcgataacggtcgcgacgctcaggttgttgatacccgccatcgtgcggttgatggaaatagttatttccggggcaccgtcttcgatggaagaaacgatattgtataatccgcctacgccttgcatacgggtctttacctcttcggtgatatcggctatttcatccagttcttccccttttacttctaccacgataggggcaccttcactacccaatagcgaactcagggagttttcctcctgccggatggtcagttccagtccgtcgggattttcggccgtgcgcacgaactgttcgatcacggcttccggtgatacaggacattccggtgaaagaaggaccttcatcatcgccgtgttctccccttcgaagatagcgttctctgagccactgccttcgccgatatggctgtaaaccgtcaataaggaatctcccgaaatagtataaagcatctcctccaggtttcctacagccgaggatgtccgttccagacgggttccttccggcatcttcactaccacggtaaacgcccggctttccatacgcggcataaactccgtcccgataaacgggatcagaagagccgttgccaccattaataaaacggctgcggaaataacgatccagcgatggccgatcagacggcgcagcagacgagaataacgatcagtcaaaaaagtattaccgaacgcagacgacgcagagggtcgtttcatcaatcggtcatacaacatcggaataacgaagatggccacaaacagggacgataccaacgagaacgtcaccgtccatgcctgatccttgaacaactcgcccgaagccccgtgcaggtaaacgatcggcaggaagaccaccaccgtcgtcaacgtggaagcaatcacagcccctgccacctccgacgttcctttgatagcagcttcgcgtacagagaggcctttctcctggttgcggaagatactttcgatcactacaatcgcattatccaccaacattccggctccaagcgccagtccgcccaacgtcattatattcaatgtgagcccgttgaagaacatcagattgaatgtcgccacaatcgaaataggaatagccatactgacaatcaatgtcgtcccgaaacggcgcaggaagacgaacaggataaccaccgccagaatgatccccaatacggcactgtcctttacctcgcctatcgcgttcttaataaacgtaccctgattgcttatcaccttaaaatgataaccgggcaatgcctgttcgataatgcccagctggcgggcgacaccgtccaccacctttaccgtattataacgcatctctttataaacagacaatccgatactccgttccccgttgatacggacgatattatcgggacgggcattttcaaacttcactgttgccacttcacggagaaaaagaggggctttatcccctgttgccgccgcagaagccgtagaagaagtgtttgcattcgtccccgcttcctgcttgctgaccggtttataaccgacaatcaggttttcgaaatcttcctccgaagcgaacaggctcgaactctttaccagatactgcaaacctaactcgctgacccgtccaccggatatgctctggttattcgcttcgatacgggaagcgatatcttctatcttcaacccgaaagcatccagtttatagggatcggtctgtatggtcaatgtactttcctcctgccccgacagtgttacttcggccacaccttccaaccggatcagctcgttgcgaatataactttcggcaaccttcctgagttccgccatatccgtaatatgctgatgcgacataccgatcaggatgacaggcgactggtttggatcatgctgtgtgatcttcaactcggtgatatccttattctgcgaaaacggattcatggctttctgtaagtcgaggaaggcctcatccatatctttcgtccaggtatattctaccgtgatacgggccgaaccggccttcaccaccgacgagacctgtgtgacgtcgctctgacggatcgccagcgactccatattctttacaaactgcttctcgatctcttccggaggacgttcgcctgccttcagttcgataaacagccgggggttattcaggtcgggcagcaggtcgacactcagctggtcgtatgagatctttcccaacaacaggatagccagtacaaccatacagatagtaaccggattgcttaccgcaaatttgacgatcttcttcatactataatctatcggtcactatttttgtactttcactttgctattctccttcagcgtctcgaagcccttggtcacaaggttgtcattttcgttcaatccttccagtacttcgatattattctcatcttccattccggtcttaatattccggagaatggcggtgttcttatccacgatgaatacatatttgcggcgacggttggactgtaccacatctttcggaatgataatagcactgtcagcacggtctaccacgatatcagccttgacaaacattccgggacgcagtttcagatcaccgttctgtatgagtacctttcctttgaaagtacgtgtctctgtactgatagccggcgacagttcactgatcactgctttcagcgtatcttccggcaatgtgtagtgggtgatatataccggctgatccgccttcacataaccgatagcactttccggcaggttgacatccatatacatccgggcatagtccataattccgaccatcggcttgccctgttccacccgcacatccgccgtataatgaggaagattgacgatcacaccgtcgaaaggagcctttacgttcatcttttccagactaagttttgcattctccagatcgtaacgggcattggtcacctttacttcggtgttacgcatttcactgagtgttactcctcctttttcatacagtgctttttgtttgttttgctcctgctcggctatctccaggctgagttctttggcatcgatggcgatgccgttctcatattctttatcttccaggcggatgatcagttgccctttcgcaacaagatcgcccagtttgaaaggtttgcctgtcttcggattagtctgaagtttataaagaccgctcatttcagagttgaggtccacgccataggttggctgtgccgtgccggtcgtattgataagcttgctaatagagccttttttcagttctgttacagaaaccggcgtggcaatatcactgggagcattctgcggctgattgttacaaccggtagttattactgctacaaataaaagagtagcaagggtatgactatattgtttcatgactgattatttttctgatattaagtctttcataggaacgataggagtattctgctcgaagtcgtacaacgagagtattttaagattcagcaactcgatcttgtagttgatgagggcctgtgtataagagatcttcttattggaaagctgtgtctggaactggctcatttccataccggtcagatccccttcccggtagcgggtcaagttcagatcataagtcagctgggcattcgttacgttctgttcggcaatttttatttgtgtacgcaggttctccaggttacgccatacctgacggatattcaattcgatgtctaccttgtcttcatgaaaatcgagttcattaatcttctgtgctactttctgtgcacgaacgcgggctttcttttctccccagtcgaagatgggtacagagaaactgatcgcaacacgtgggttctgtgtcggattatcataaatattcttcaggttacggttgtcaccgatcaaaccgaaagagacggcaatatcacctttgaactcgttcagcgccttcgttttaatcatttcaaaccccagttcatcactctctatctcacgctggcgaagttccaggcgcgattccaggccgtgtgaaattgcttgttgcagatttacatcgattggtttgatatctatttcggcaaacaccatcaagtcttcattcagattcatacccaatgtctgctttaacttatccttcgcattttcaagtgaaacctgttgctcctctaccgatgaacgggcggtagccaggttgagttccgcttggaagagttcgtcttttgccgccaggtcggcttctaccttattctttataatatcgtaactttgccgggcattcaccagttcttcgcgggtgatagccaactggctctgcgccatatagacattatagaactggttagttatatccttttcggtattcagccgttgcagggcatagctgatattggcattctcgtaatcatactcgatctgtttcagctccattttccgcttgttgtaagtgaagataggttgcgagagttggaggtaaaggttattgttaaatgccttgttactattcgtcgaaccttccacatccgagttattatcctgccagccgaaggtgtttatcaaagagactacaccatccgtccacaagataggctggtctacccggaatgtaccgctcgaactgaacgtttcattggtgtaccactgcgacaggcggttatcgaaccggcggtttttattataatccaccggattcagatctaatgagaaccgggatttaagggaagcccgttgggcaaccagattctcctgataccggtccagattcatatgcgaacgacgcagagtcggactgttctcttccgctatatccaacgctttctcaatggtcagagacagttgtccgtgaactgtcagcggcactcccagcagtacggcaatcgtaaggatcatctttttcatcaatagtaactctctttgcatattcagatcatattaattagtatcgtttgaccagtttaacggcatccgccgctacacttcttagtttacactcatttgtcagggtgatataagccgtatcggccgtgaaataataaacacccaactgctcccagccttcattggctctccgcaggttgatataggcatcttccggctcctctccctgccttattttgaaatggtattcaccttctacccggtcattataccgcaattcattacttttgctcacgtaataatagagatcatattgtccttcggccggtatagggaccttccaggtggctgtctgacttccattgccgctttttatcacataagcagagcggatgtatttaccataatagttgttattggttgtagccgtccattgtaacggcggacgccagtcggaaacaccggaatatttaaaggaggtatcttccactttatccaaccatttaggaagcagtcccactacatccggttcagatagaacgaatagagaatcatcctcgttatcgacaatgatctcatccgtattttcacgtgaagaaccggaaatgataaaatctccttcgacatccacatctcgccttctctcttcttttatatttcctatctgctgactgattacactcggcaaattcccggagatcatagtgttgaccattacataccgcggagcattctcccatacggataccaacaatttcgtctgatgcggttccagtacgattttacggttagcacgcggatcgggattcccaccaccccgttgtaccccctgtatttcgagatggacgataccttcattatccgaattattgcttatctgtactttcaacacaaaattctcctcccctctgtttgtcactttagttacctcaaaccgttcagcactataataaggaagaggcgtaagacgttcccactccgaaaaacccgaacgaatatctgcatggctcacccggcctagcgtatccaataagttttcaaactggatattccggaacgtattccgttccagcaatgtataaagagaatccctgaaagcatccactccgatattgatttcgggtacggcaaacagccggtacgtcttcagactgatgatattattcaatagatcgcggtattccacgtccgtaagcagttctttaaaagtctgcttctccatcagcaggcttgccttttcattattactgataccattgatatcacgttcccaacccgagttatccgactttttttgcaagtacagttcaatagccgtattcgctatcggccattcgggagaaaatatattataccggaaattgtataactgtggaaacaggaagtaggggtttgcttgtgacgagatattataatttccacgaccactggatgagaagttataattcccctccggacgggtaaatatccaaagaaagttattcaatgtccgtatttttgcttctttctcagtaatttcacggcctccatttttcgaccatttaagctggttcctccaggccctgtcgacatccaactgtccgaatacacaacctttttccggaaaaagaaccatttccggctgtactgcttcctgtgcctgcgaccaagcgcggggataggtagagaactgcacgggaacctctacaacagaaaaacgcttgaacggataagacagtttgtaggtacgctccagattctccctgatattatgaataaaagaagggatcgtatcgcggatcgaatcaaaagtagccgtatagtaatcgttcccttcaatatgccagatactatatagggtactgtcagactccagtgtttgttgtttatatttaccgataatcaatgaaaccgtctgtgccggatattcggcggcaaaagaatagctgccgtcttccgctttcacactttctccctgcgataagggaaccaagccgggaagcggttttatctgcaacccgaacttactgaaataagtctgttgccaatcagaactaagatcgctgtaagccgtaccgggacgaggataccaatatgtttcgggagtaaacaatacataatccggcgtctggaacacatattgtttatctatattgaacaggaaatttttatattcctgctgcaataccttagccggaatatccagatagcaaaaccggctgtttattcttccaccatatttaacagagaaagtaaccgtatcggaaggaacgatcttttcaccgaaatcgaccaacaggatctggttatcccgctcaaaatccagcttcttccctccccatgttatttcctgtacctgcaaacccggattcagacagaaagtaaagacagaagcaggctccaatgccgttcctttcattgtcacttccgaagagaatgtttccggtagttgctcgaatgaaatatcataccggtctataatcattttaggggtatgcacatatttattattaatagcggtatacaacgcacgcatatcgctctccagcaatatggaatgtacatgtttataaccggcagctccactgatcgacagcatacaaagggaaagcaacaaccagggataattgctgcgtgaagaattaggcagacgtctgaacagaaagatcgtaaaaaagataaaggccaggccggcaaagaaatagatcgcccgatggtttaagactgtctcccaattggtaaaaccgacaatcgtagattttaccaacggcaggctgtaagccatataatcgaataaataatagaatttatcactgatataaaagattgtcagaccgatatatcccaacaggataataaaggtaagtgcctggttcttcaataccagcatcaagaaaatggataatccgatgataaaaaccaacgtcggaatacttatcaacaggaaataaagaatatacgccatccagtctaccgccattcctgaagtcataaagttaaacagcaaagctattcccatgatgatcaggttaaggatcagaaaaacacgcaggtttccccatattttaccgatcacatattcggcattgcttaacggacggacataaaacacctccgaagtatcgagtttcttatccctcttcaggaattccgaagaaagaaatatacagatcactgcttgtccggtatttaataagagcaggttcaagtaagggagattggccggtatggccttcaccagccaaaaaccaccggagtcttccatgatcagcagagcaaagtcaaaaaatccgagtatcagaatggccagtatggtaaacactttaaagaaccagctccggatcagaattttactttcgtattttgctaccgattgtatattgttgataaacgacatagagggtcaattaaaaggttattaatcgttggtccaaaggttcagtttattctccatataatacacataagcatgttccagattgggaggatacgattcagcttcatatccaacgatctcatcagccacaacctgcacttcccaaccggagccggaaggaatggtcgagattacggggtatttcttatctacctcgtgcaattggtcgccggttatttttatacgccagacttttccttctgcttgtttcaacatatcctgcggtgaaccgtaaaaagaaacctgtcctttgttcatcagcgccatacaattacaagtactggatatgtctcccacgatatgggtagaaaggatgatcgttacgtcattctcactcacttccgaaagcagattacgaaaacggatacgttcttcaggatcgagtccggtggtcggctcatccacaatgatcactttcggatgatggatcaatgcctgggcaatccccaaacgccgcttcataccacccgatagtttatttgcataccgttcgcgcacatcgaacaaacctacattttcgagcatagcatctacagcctgctttctttgtttaccgttagtcatacccgacagacgggcagcataatccagaaactcatgtgttttgtactttgcgaagaaacggaagtcctgcggaagataacctaatatgcctctgatctctttgcgctgcctgagcagatcatacccacagatatccacttgaccggaagtcggctccatcagagcaaccaggatacgcatcaatgtagactttccggcaccattcggacccaacagtccgaacattcctgtcggtatctccagattcacatctttcaatgcgtggtttccgttcggatataccttattaaggttctttatcgatatactcattcagtcaaaggttcacgaaaagttagaattaagtcgtaatacgttggtaaagatatattttattcacatcactacaaataaaaaacgttcccaaccaaaatatattagttgggaacgtcctaaattaaatcctgataaggaaattttttaataattttgcttcattggttcgaagaatgcctgcgggtgttcgcatgccggacacttcatcggagctttctttgcttcgatcacgaaaccacagttgcgacactgccagaagatagcttcgtctttttcaaatactttaccttcagtcaggtttgccaacaacttacgataacgtctttcgtgttcagcttcaacctttgcaatcattctgaaagcaacagcgatttgtttgaaaccttcttcttctgcaatatcggcaaatgcaggatatagttcagcccactcttcgttttcgccggcagcagcttctgccaggttttccattgttgtgccgattacaccggcaggataagatgctgtgatctcaaccatgccaccttccaggaatttaaagaaacgctttgcatgttctttttcttgttctgcagtttccataaatacaccggcaatttgttcgtagccttcttttttggctgtgcttgcgaagaatgtataacgacttcttgcctgagattctccggcaaatgatttcaacagattctgttctgtacgtgtacctttaatacttttttccataatgctaatatgtaatataaaatgagtttgtctaaatcgccctattcaaataactctcaaagttatgaaattgtttaataatttaattcattcatttacttaaaatatatctatcggattataaactatgtctatcatccggcagtatttaccgatagcttttaaaagaatgtaaccgattttgcataaaccccaaccctaatttggcttttttgaaatgtcgacattgcaaaatacccgattatatacactttcgataaatattattgtatctttgcatcaaaatttaacataataggcagaaagatgaaaagcaaaattgattttcagcccaaacttatatcggcgctgaaaaattattccaaagaaaagtttatgaccgatctgatggcaggaatcatcgtgggtattgttgcccttccactggccatcgcattcggtatcgcttcgggagtaagtccggaaaaaggattgattacggcaataatcggtggatttatcgtttctcttctgggaggaaattccgtacagatcggtggtccgaccggagctttcatcgttatcgtatacggaattatacagaatttcggtatcgaaggattggctatagctacggtgattgccggaattatattggtagtaatgggagcattaaaactggggacggttatcaaatttataccttatccgatcgttgtcggctttaccagcggtattgcgttgaccattttcactacacagatgaaggatctgttcgggctgacaatggaaaaggttccggccgatttcatatccaaatggattgcttacttcgaacatttccatacgatcaatccctggtcgttcgtgatcggaattatcagcattgttataattgccgtctcacccaggttttccaagaagattccgggttcattgattgctattattgtgatgacgatcattgtctatatcatgagaaatcagctgggtataacaggcatagaaacgatcggcgaccgttttaccattaatgcttccctcccgcaaccggaagccatttctttcaatatggaaacaatcaacctattgctcccctcggcatttaccattgcgatgctgggtgcgatagagtcgcttctttctgccacagtggccgatggtgtgaccggagataaacataattcaaataccgaactgatcgcacagggagctgccaatatcatcgttcctattttcggaggtattccggtaaccggagctatcgcccgtacaatgaccaatatcaataacggtggccgtacaccggtagccggtataatccatgctattgtactgttgttgatcttactgttcttgggaccgttaaccaaacatatcccaatggcttgcctggcaggtgtgttgattatcgtatcttacaacatgagcgaatggcgcacgttccgttcattgatgaaaaacccgaaaagcgatgtttccgtactactggttacttttttcctaaccgttatcttcgacctgactattgccatcgagatcggtttattgatcgccatgttcctgtttatgcatcgtgtggcagagacaactcgcgtttcagtaaccaaagacgaaatcgacctgtccgatgatggagagatacgccatgatgaagaggtattggttttgccgaaaggggttgaagtgtacgaaatcgacggtccgttcttcttcggtgtagcgaacaaatttgatgatgtgatgaaggtgatcggtgacaaacccaaagtacgtatcatccgtatgcgtaaagtcccgttcatggattcgacaggcctgcataacctggaaagtttgttccgtttatcgaaagctgaaaatatacacatgatcctttcgggagtaaacgatgatgtgcgccgtgtattgatcaaatccggcttcgatcaaaagataggtgcgtataatatatgttcaaacataaacgaggctgtgaagaaggcagaagaggcagtggtatcaaaacctgctgaaaatatgcactgatgtaagttaccgattatttagctaaacaataaattcaaacctatttctaataaaaaaggctgtgcctgattcccccatgaaagggatagcacagccttatttatgccatgacagctgtttattcgcttatgcgaactttatagctctgatcattcaaacggacaatgtaaagaccttgcggcagttgtatttgggcttcgctggaaaccagggctgatttcaccaactggccttgcatattgaatacgttcacctgggcagttgcttccggctggatatacagaataccgtctgctgcatatactttctgagcggtagcgttgatctcttcattggctgtttccgtattcttgacaatgccatcgattttaacgaccatatcggctgttaccggttctgtcacataattcatgttggcatccggttccagtgttttatcgccaacggttacaaccggtttggattgattatattcttcctccaataccaaagagaaacggaaacgttcgccatcttctatcgcagagacaccttcgcccggcgtggttgttgcacctgtcagaagaggcaaggtcacattatgcaaggcttgaagagctgggtaatcgtcttttctaaactgccagcgtgtagtaccttcaggcaataacttattaagttcttctacaaactcctctgcctttgcatcttcttcttttaacacatacaaacagttttctgctttagattctccaaacacgaaagaagtaaaagcaggttcagtaggagtagttacattttcactcttcaacgttgttattgcactccacgcatttgacagtatactttttgtattcaaaacagctacaacacctgctgtatatacatttgtcttaccttcttcctgcttattatcagctatcgatacaatagactctcctacgcttgcaacgttcataatttgactattttgggtaaaagcagccgtccctgccgtacgaaccaccaaatcagtagtattcccggaaacctggttgtccaatttaacgtggctaatacaatcaataactttcgaatcgtacatttcagccacaagacctgcgacctcagcgtaacataattttccatctttcagtacagtctcattctgataatttccataagtacgacagttttcaactgtactattacttaaagctgcagccaaaccaccaattaccgatccggatacttttcctttagtccgtaagttataagtaccatctgttgtacagttgattatcttcccatactggacattggccgctaatcctgcagccatcattaagtaatcggtaccttccacgtcaatatcgatctttgtaccgaccatacgaatatttttaagagttgcccctccacaattcacgaaaagagccatatacatattactagccttttgtgtattgtatttcaatgtataattctttatagcatagccatcgccatcatacgttccggtaaaccaggctccgttaccgataaaggtcatcgggtcatcttctccaaaagtgatgtcggctatttgcttaaagtaaacccccttcaatttctgtgggaatgtacccgaatcatccgaagacaatgcgccaagattacgtaaatgttccttggtagcgatcagatagggatctgcctctgtaccggaaccaccagcgaaagaagaggcatcagcttttgtttgaactggtgatacgacataatctaatgacttgacaggtttatcaatctccatagaagcgaatgctccttcatttgtttgtgcattcacaccacacgcaacagccagaaaagccattgccaaagtaaaaattttcttcatactcattcaaaattaagttagacatattactaaattcaaatattgttttcaggcattaacatattttaggcgcaccgtctaaccaacattggttagacgaactaagtgcctctggtaaatgtgtgtaagtaccgttggttagacagtctctccaacggcactgagaaagactattcaataacaggacggtcatcttcaccaccgccacccggtttttcacctacataaagtagtaccggaaacttataagtacgtggctcttttacaagtttgttaccggctgcagactgggtaacaatacttaatgtgtattcgccatcttcgagggcaggcaacatcacagtcagttcagaaggattgttgtgaaccagcaacggacatttctgagctgtaccgcctgtcttagtgaagaaaacacccaggtttgcatcatcgccggctactttgatattcgatccggagataacgacaggagctgcagaggtaagttgtgtgttcatttcaccggtagtagagtcgataatcgagttgatgactgggccggtaacggcagtacgggtatctatctctacattcttcaatgtgtcgcgtagtagtttaccgggtacataactggcagtgagtttgtttttagtagggtcgaaagctgctttttcaccctcaaaagaaccagtgatagtagccatgtactggcctacaccatcaacaacacttttaccttcggcaatagcggttactttttcctgatcactcatacccaggatatattcgatcgtatccaggcgtaattcagaacctcttgccagaatgcgttcggcaatttgtttgttgcgtaccgttccggtgatacggggctttgcggtgtagtcacctttacgctccgtgacggcgttgtcgtaaagatcggcagtcaaaatgattttttcagccatgattaacaataaatttatgcctgctggttgggctgggcgtttccttttttgatgattaccttatttgtgaaataagggtagttctttgtattggatatttagtggtagagagtaacttttccccttcggagagggggggaggggtgtgttaaaacgagctatatagacggctagtgacacaccccctgccccctctccagaggggaaaggttacccttagccccgctatgtccatacgtcagccgaaaacgccccaattctttataaaggcacaaatcatcccccacccacctaaattataagcaagcaagtttgtctttgtttaaatataatttctatctttgccccgtccccatactaaaaaggctgtgattttcaaagctggcataaaatggggcaaacacccttatttcacaaataaggtctcttaggccctcactcctatcaaactatccagtccttttataataatcttgttggcagcattgagcctcgactggtcgagtgtagtcagatagttacgtgttgtcctttccgacgtatggccgagggcctggctgataactgctatcggcgtatcgttacgcaatgcctctgtcgcccaggtgtggcggaaaacatacgaagtcagatggatagggatgaccagacgttgaccgatttctttcaaacaactgttgtaatgatgaagggctttcttataggcttcatactgcttctccccattactctcttcggacagaatggggaagagataacggctaccgggttgcatgtatttatcgagcagtcgttgcatcccgggggtgatgcagacacgtaccagggtaccagtcttacagcggttatagactaattcaccggcgataatattgtcggctgtcagatgcgccagatcgacaaaaggcagtccgcaagccagaaaggagaaaagggcaaagtcttttgccatctccaactcatgactatccgacaaatccatctgcacaatctcttcgattgtttccctacgaagggcacgtttggcagtttctccttgccggaggttgaggtgcgcaaaaggcgaaagacagttcgacggtgccaacccttcgcgcacagccatatgaaagatggcacgaaagctactcagatagctgtttatcgaatttgttttcagatgtcccaatgactgaagccattcacggaaacgatcgatcaagccgggagtgatatcgtcaaacgacagggaatcatcaccccggaactgccggagccagttggaggaagcacggtagaggtcggcagtcgaaaaatgcccggccttacgtttacgcttcaccaaagtgtcggcataagtgaagaaaaaggttatcatacaatataatttagaaataaacaaaacaagcctcccgtcctctgaacgaggaacaaagaggcttgccaattaaaagaataaactgttctattcagtaattgttacccggtcgccattaaaaatggacagacccagtttattcattatatatttgatcgccaactgagctttcacagagtttcctgcgctgtcaattggtggagcgaaagcagcgataccgaacaggccgggcattacgcccattacaccaccacctacacctgtttttgcagggataccggaagtatataaccaatcaccggtatgttcgtagaaacctacggttgcgatcagagatgtgatcttcggtgacaatgagccgtcgaatatctgcttcttcgataccgggttcaggccgtcgttagcaatagtagctccgcagacagataattgagctgccgtgattcccagtgaacactgacgagtatacaggtcgagcgacatatccggatcgtcgtaaatacggttgtagttcttcaataaccaggcaatagagcggttgttgaagttggtggccgattccgacttatacaattcgtcgatcaactggggagcactgccgcaaagatcggtaatgttggcaacaatggcatcccacttcttggcggcgtcacctatcggctgaaccatactgcaagcagtgatcgcacccgcattgaccaacggagtagaaggatgatccttctccagcaagatagccatgatagagttgaaaggcagtccggttgcatcggcaccgatcatttgcagtaacttctctgcaccgtattggcgcaaagcaagtacagcggtatgtactttagatacagattcgataccgaagcggtattcggaatcacccaactggatgatcgtcccgtccatcagacagacactgataccgaacaggttcttatctatattggccagataagggatgtaatcggcattctttccgtccgtgttggccttgtacatcccataggcttcctgagccgcctcctttatttgtgaaacggaaatctttttatccatactcaaatagtttacttagttgatttgggaatacctgtatgagtgaaaacagaaccttttactttctggtttctgtcctgtgcaatacgggtaggagtaggatattccagtttttccagatcggcaatcgcattgctgatgtcacccagtaactggtcggccatgtcgcggctgaagccctggcggacaacgatacgcataactacccagttttcaaggttgtcaggcaatgtataagccggaaccatccatccgctttgtttcagtttgtcctgcaagtcgtacaatgtccatttggcattctttgcatattccggtttcaaataccagataaacaatgggttcacaacctctttactgtagttctggaacggagccatctttgctatttcagcatgcaggtaatcggctacagccatactgttctgctgtacttccttgtaaccctggaagccgagacggataaactggtagtattgtcctaaaatctgtgcagcaggacgggagaagttcaaaccgacctgagtgatgtttgcacctaaataatttacactgaaagacatggaacccggaaggtatttcttatctttccaaacgacccaacctaaacccggatataccagaccgaatttatgtccggaagtactgatggaaagtacccatttcagacggaagtcccatttcagttccggtttcaggaatggcaggatgaaaccaccggaagcggcatccacgtggataggaatatcgtagccagtctttgcattatatgcatcgagggcagtgtcgagagcttccacgtcgtcgttcagacctgtccatgtaaccccctggataggaacgatacagatcgtattttcgtcacacatcttcagggcatcctgcgggtcgagcgtgatatgttcctgtgtcaatggcacctggcgcatttcgatctgccacaactgggcgaatttttcccatacaacctgaaatccggcagagatcacaaagttaggtttgtcgaccggtttgccctgagccaatctcttttcacgccagcgtaaccaggctgcaacaccacccaacatacacgcttcggaagaaccgatagccaaggctccggctttccactgtgcctgttcggggctgttccacaggttagccatgatgttgatacatttagcgttcatcacagcgatacgcgggtactcagtttcgtcgatatagttgatgttgattgcttcgttcatcaacttagttgcgtaatcgtccatccaggtagtaacgaatgtagccaggttcagacggggttgtgtctgggcgaaagtttcgtcttttaccatttgatacgcaatctccggagtggtagggccatcaggaattacgtctaccggagctggatgcaacattgcattcgagccaaaaatcgcagttttggcatcaccttctctaaaacttgaatctttcatgtctttttgtttttaattatttaagaattggcgcaaccgacattcgtgcgtcgatttgtagtgcaaaaacagcctccatcggcaattgttcttcgattttggttaatcctgcaatatttaattacttttggcttgatccaaaagtaaacaaaagatcaagtctgcacctgcctcgctactccgcatcctacgttcgctgtcgtctgcgaaactcgcttcgctcaaacaacgcagcctccgggcgctcactccggctgctgcgcttaacgctcgccagctgaggcctttccaaggaagctctgcttcctctaaggattgccgataccgatagtttttttagtaacggaaataacctttcaaatgaacattcagccataagaattgtttcctgtcttataaaacagctatttaagtatgagaatacagacaggacaagggacgattccccttattacattaataggtatatggtcaatctcggcattgaatgcgctaccggggttggcagtctcccctatcctgggaaaactttcggctatatttccgcattcgacggaactggatatacaaatgttatcctctttgccttcgttgctgattataccttttattatattatccggcaaactgaccgagaagatcaataatatatggttgttacaaatcgggctaagtatttttgccgtcagcggtctcctgtatctgctttcgacgaagatgtggcaactgatcgccgtcagcgcattgctgggtatcggttcggggttgatcgttccactgtcgaccggccttatttcgaggttctttatcgggacttaccggacaaagcaattcgggctgagttcggctatcaccaatgtgacgctggtgttggcaaccgtactgacgggttatctggcggaaatcaactggcatctgccgttcctcgtttatctgttcccgcttatttcgatcgtactgtcattctatctgaaaaagaatatcagccccctacccgtccatgcaacggcttctgctgaaaacaaggcggccccaaccgatccttcattcggaaaacggggcatacagatcaggcatttgatgcaaatcatggggttctacgggctggcaacttatctggtgattatcgttagcttcaatctgcctttcctgatgaaggaatatcacttcaccagcggtaactcgggtattatgatctctcttttcttcctggctattatggctccgggattcgtactgaaccagatcgtcgattattgcgggaagaaaaccaaattctacagcctgctctccatcgccctcggtatggccttgatccttatctcgcggacagagtggctgatcggattaggttgtatctttaccggattagggtacggcgttatccagcctattgcctatgacaaaacaacccggacagctatcccggaaaaggtaacactggcactggctttcgtcatggcgatgaattacctggctatcctgctttgtccgttcattataaatgtattcaaagatttattacatatagaaacacagcagtttgcgttcatattcaatctgatcattgcactgattgctgccgtatgggcgtatatcaaacaggactcattcctgttcaatgacaatatgtaaataacttaaaaacgtcaaacagtatgaagaataagaagacagaagccaaccttagtatgatcgtatcgaaaaccttcagcggcctgaatgcgaatgcactcaaatatctccttcccttatggatcgctccgctgacaggggttatgttccgttgcgtattcgctgccatcatgttctggatcatcagtatcttctggaaacaggacaaaacgacccggcgggagaagatcaccctgttcctgctgggggcaatcggtttatatggctttatgttcttctatctgctcggggtcagcaagacgacaccggtatccagttcgctgttcagcagcctgcagccgatctgggtatttatcctgtcggtcctcttcctgcgggaacggattacagttatgaaaataattggtattgcgatcgggctaggcggtgcactgctctgtatcctgacacagaaaagcgatgatctggcctcggatgcctttacgggtaacatgctctgcctattcagttcaattacttatgcggcctatctgatcattagtaatatagtactgggaaaggtcagttcacttaatatgttgcggtatagctttctgggagcggctgtttcctctttgatcgttatggcttttaccggtttcgacggtcatctgttcagtcatttcgaatggcagcctttccttatactgatgttcgttctgatctttcctaccacaatcagttaccttttaattccgataggcctcaaatacttaagtactacactggtcgctttatacggctacattatactgatcgttgccaccatcgtttccctttccatcggacaggatcgtttcagctggtaccagatgattgctattgcactgatctgctcaagtgtctacttcgttgaaatagcggaaagtaaggataaaaagtaaatattttccctttctttgtaacaacttattcttcgatcccgtctctcttatgaaggctctccacaaagcacgcatcagaggggccggaacaacagcttcaatgtgatccaattatccgggaatttcacactaaaagacattcaagagattacaaaagagatcaataagtaaaaaagatatcccttttcatattccaaatatatccttacatttgcggatactccggcttactatccggagtacctatcaaataacaaacagtggagcagcgtatgaaaagtggaatagagaggttgaaagtactggttactttggtaacaatgcttttcatgtctgatatcgtatttgcagaagaaggaaataaaaatataccgggagacggggtcgattctgtcgcttggtcgcgtcgtttgatacatagattaggcatcgacggacgcccggcttacattttccctaccaattcttttctgaaaggagataactgggatcagaaaccgatccggcaatctatctccgcccatttgaaatactctttccaatactacccgaacagctacaccgatcgtatttacagaggtgcttaccagggcatcggattaagttggtattcgtttgagaataaagaagaacttggaaaccctctggctgtttacctcttccagggagcccgtatcgcccggttcaatccccgcctgtcgcttaactacgaatggaatttcggggtatcgtttggttggaaaccttatgatgaatattacaatacgcacaacaaggtcatcggatcgaaaataaatgcctatatcaatgtaaacttctatctgaactatatgctttcgaagcagatagatctgacagcaggtgttgacttgacgcatttctcgaatggaaacactcgattcccgaatgccggactgaatacggtcgggttaaaagtcggattagtttataacttcaacaggaacggagattgtttttccaagccttttttccagtcccctgtaccaaatttcccccgtcatatcagctatgatgtcgttctgttcggttcatggcgacgcaaaggtgtttatgtcggagatgggcaagtggccgccccgggagcttttgccgtagcgggattcaacattaatccgatgtataatttcggatataacttccgggcaggagtatcgttggatggtgtctatgatgaaagtgccaatatttatgccgaccaatattcttccgatcgtttttaccgtccgccgctcagctaccagatggcgctgggactttccgccagggcagagtatgtgatgccttacttcactgtcggtatcggtctgggaggaaatgtaatccaccgcggtggtgacttaaaaggattataccaggttctggctcttaaaatagaagtcacccgcagttcttttatccatatcggatataatttacaaaacttccatacccccaattacctgatgctgggtatcggataccggttcaataacaagtatccgacgttccacaggtaaaaaatgtttcacattttccttacttccctgtaatgatcttccgtatctcgcttaacttgttgagcgcttcgatcggagtcagattattaacatcgaggttctttatttcgtcgcgtacctggctgagtacgggatcgtccagctgaaagaaactaagttgataaccttcggcggcggaagcgatttcttttacaggtttggcttttaccttgccttttcctttcgccttgtctttacagtcgataccctcctggcggttatccgtttccagctgtttcagaatctcgtcggaacgtttcacgatactcttcggcattcccgccatcttggccacatggataccgaaactatgttcgctgccaccgggaaccagcttacgcaggaagatcaccttattggatacctctttcaccgatacattataattcttgatacgcttgaacgaacgctccatctcgttcaactcatgatagtgagtggcaaaaagcgttttggcacgggcattcggatgctcatggatatattcgacaatcgcccaggcaatggagataccgtcataagtactcgtaccacgtcccaattcatcgaaaagaaccagacttcgcgacgacatattattcaggatattcgaagcttcgttcatctccaccatgaaagtcgattcgccgacagaaatattgtcggaagcccctacacgggtaaatatcttatccactataccgatacgggctgcttcagccggaacgaaacatccgatctgagccatcagcgtaatcaatgcagtctggcgcagtaaagccgacttacccgccatattaggccccgttataattatgatctgctgcttctcgctatccagatacacatcattggcgatatagggttctcccagcggcaattgcttttcaatcaccggatgacgacccaacttgatatcgatcacctccgagtcgtccaccatcggacggatataacggttactttcagccactttggcaaaagacagaagacaatccagacgtccgatcaggttcgcatccaactggatgggaggaataaattcagccagacaaatcaccaggtcattgaacaggcgaccttccaatgcaagaatcttctcttcggcacctaatattttctcttcgtattctttcagttcttcagtgatataacgttcggcattcaccagtgtctgcttacgaatccactctgccggaaccttatctttatgggcattacgcacttcgatataataaccgaatacgttattaaaagcaatcttcagactggggataccggtcttttcactttcgcgctgttgcaccttcaacaaataatctttaccggagtaagcaatcgcacgcagatcgtccaattcggcatttaccccctgggcaataacgcctcccttgttcaataaggcaggaggatcgttattaatctccttctctatcctttcacgaatctccagacaggcattcaactgctcaccgatacggcaaaggctgggttcgtcgctgcccatgcaagcatcctttatcggctcgatggcacgaagagccaccttcaactgtacgacctcacgcggcgatacacgtcccacggctactttcgagatgatacgttccaaatcgccaatctggtcgatatgtgcatccaaaagttcttttacctccggatgacggaagaaataatccaccacatcctgtcgttcctgtatcggttttgcatctttcagagggaaaagtacccaacgacgcagcatacgtgaacccatcggagaaactgtcttatcgatcacatccaacaggctggtaccttcatcgttcatcgttcctaccagttccaggctacgtacggtaaatttatccaggcgcacataccggtcttcctcgatacgggacaaggcggtgatatgcgaaatatgtttatgttccgtctgatccagatagtagaggattgctcccgaagcaacaatacccagtttcagatgctgcacgccgaaacctttcaggttcttcgtttcaaaatgcttcaacaggcgatcgttggctgcctcgtcggagaaaacccaatcatccatttcaaaggtaaagaaacggggaccgaacgactcctcaaaacgtttgcgattattacgttcgatcaatacttctttcggagagaagttattgagcaatttatcgatataatcgattgtcccttcagcagtcaggaattcgccggtcgaaatatccaatagagagataccacagacatctttaccgaaatgaacagctgcaaggaagttattttctttatggttcagaatattatcattgatagaaacacccggtgtaaccagttccgtcaccccacgcttcaccagcttcttggtcatcttcggatcttccaattggtcgcagatcgctacacgcttgccggcacgcactaatttgggaagataagtatcgagggcatgatgcggaaaaccagccatttcgataaactggcccggtccgttggctttcttagtttgcacgatacccagtatttcggctcctaccacggcatcctcgccatacatttcgtaaaagtctcctacacggaacagaaggacagcatcaggatgtttcgctttaatatcgaaatactgcttcattaagggggtttcaactatttttgccacaggaatatgcttttatcatttatactaaaccgtacaaaggtacaattttttgtgaaagtatggaggtaggaaataattcagaaaaaaaacataactttgccgatatgtctgacaagaaacatcttagattcatgaaaaaaactattttactcgcttcgggcctgattgcggccatcccttttgtgcatgcacagaaaaacaaagacaaaaaaccgaatgtcgtattcatcctggcagatgacctgggatacggtgatttgagttgctacggacaggaaaagttcagtactcccaacatcgaccaactggcgcaaaacggtatacgtttcacccagtgttattcgggaacaactgtcagtgccccttcccgctcctgcctgttgacaggtacgcacagcggacatactcctatccgtggaaacaaggaactggacccggaaggacaattcccattgcctgccgatgcacgtactatcttccatgtcatgcaggatgcaggatacaagacttctgccttcggtaaatggggattaggttacatcggcacctccggtgatcctaaaaaccagggttgtgagacattcttcggatataactgccagctattggcacatagctattatcccgaccatctgtgggacaacgaccaacgtgttgagctgaaagataacgtattggatgtggaatatggaaaaggaacctattcgcaagacctgatccactcgaaagcactcgattacctggataacctaaaagaagacgaaccattcttcatgtggtatccgactattttacctcacgccgaactgatcgttccggaagacagcatcattcagaaattccgtggcatgtatccggaaaaggcacataaaggtaccgaaccgggcagtccggcattccgcaaaggcggttactgcacacagctttatccgcatgctacattcgcagcgatgatctatcgcctggacgtatatgtgggacagatcgtacagaaactgaaagacaaaggattatacgataacacgatcattatatttgccagcgataacggccctcacatggaaggtggtgccgatcctgatttcttcaacagcaatggtatctaccgcggttacaaacgtgacctgtatgaaggcggtatccgtgtgccgatgatcatttcatggccgggacatatacagccgggaacagaaacgaatttcatgtgttctttctgggatgtattacctactttcgaagagatcatccatccgaaagcgaaacagaaagaaatggacggcgtaagcatgctgccgctgttacaaaaccgcaaaggacagaaggaacatgagttcctgtatttcgaatttcaggaaatgaatggtcgccaggctgtacgccagggttcatggaagctggtacacatgaatatccgtggagataaaccgtattatgaactttataacttagcagccgatccttcggaaaaatacaacctgttggataaatatccggaaaaggtagccgagctgaaagagatcatggttcgtgaacatatcgaagatccgaactggccgttgctgaaaaaataaagatcatttcgttggcttcaacgaaatgataatacaaaatcaggccggattattgttaacaaaataatccagcctgatttatttataatacctgattaactctgattatttctttaccagtttatgactacttcttccggccgcagtcacaacttccaatacataaattccggccggatagctatcataagaaagtgataattgagtattattaccggctgattgttttttgatcaatcgtccgttcatatcatacaaaaccacttctttaattgcaataggggcagttatctgaactgttccggccacgtcataagaaacggaaacacctgttccaaccgttatattttccgttgaagtagaaggatcggcagccaccacgatttcaccggtcgtattgttattgcctcttacccatttccattcacttccatcgctacttttatataacaaacggatacggtcaccgggagcaatcgtttttgtgatcatacaaggaacttcctgtcctactccatgttcgatctggatagtaacaggctcttcactggagataaattcttttgtattcccgtttttgtctacaagagcgacaaccaggttacctgaaaaatcacggatactcatattgcctacataaccatactgaacaccgaaaagctgattttcttcaaaatcttctgtggtggcttcaaggccggcaaagactgttccctgattttccccatagaaaaaggctaatacatcctgataagtagaaccttccaccggctttttcatactgataatggcatcctgaccaagcgagaaaccacctccgctattaccaccggttccctgcacttcaggttcgaggacagacagcaggtaatacccgttagccagtccgctccatccccaattcacatgataataatcagcatcgttgtaaccgtcgatgataaattgatgaccttctttctgatcattttcaccaccatagacaacagggcgattatcatccagttcacctttgataatcgcttcccattcgtctttctgataattatcgcgttgcaggacatgaagggatttatcgtatttcatataattgacaagcccctgggctgcagtcaatgtcaaggcaccgctgttaccgggagcataattcatttctgagaaaacaccgcaatcgtacattagggtagctacattttgggcctgctcagttgtatactgccctgccgtgtaggtagaaggcatgttatcccactggtatggagtatcgaaagtagcggaaagagacagattgtaggtctgcgaagtataagaatgactcccctgccctacgtccggccatttatgatattgcatcgcgatagccgtcgaggtggcaacacaccccgtcggcgtacgctggctatttactaccgggcataagttattataaggtgtcatctgatcccaaaggacagttgttaacaacgttccggtcgatttcaactgcatcttgccttggcgaacttcgttccaggcggctgtgacgtccttcgaaacctccggtttattttcacgtatccagttgatctggcgctggtaactttcaaaccatccacgcaggttggacggcatggagtctttttcaaacagttgctgcataccgtaacctagaataggatatacgacatcatcaccagctacaacgacaaagccgtcggcatcttcacggttaaatacgtaaaaggtagcatcctgtacggaaccggctgatttggtaaccgctccggcatccgaccagaccagtgtcactcccgactccgaagcttttgtctgcggaaaattacttttcaggaaactgagggctacgctcttcgcctgttttacatcaataggtgcagcacttatcgacattgtcaacaaggcgataaagaaaataaaagtacatcttctcatactcgtcattttttagtttaaacttagtttgcgtttatcagaggtttggttgaagggtattaatggcgttttacttaattcattaataaagatgttcttataacaaagaaaggataaaaatagttttcctttccactttatttgaatgagaatgcatagatcattaaaataagtatatcgaaatcttctgacaaataaatattattcatacatttagccacttattaatcaccaaaatttataaactatgaatttacagataatacaaaacaagatttatgagatcagaggacaaaaagttatgttggattttgatcttgcagaattatataacattgaaaccaaagtattaaaacaatccgtaaaacgtaatataaagcgattcgaaggtgaggactttatgtttgaactttctaaagaggaactttcaaggtcacaaattgtgaccttgaacaaaggaagaggaaagaacttcaaatacatgcctttcgctttcaccgaattaggtgtagccatgttatcttcagtattaaatagtgatattgccatagaaataaaccgtaacatcatgcgtgcctttgttcaaatgagaaaacagtttatctcaaattgtgataaactgtctactaataagaagctatcagaactggagcagcaagtcaaatttcttcaggaagacattgaaagtctcagtaaagatcatgaaaactacgagcaacattttgacgatatctatcttgccctggcagaacttgcctctaaaaataaagaaaagccaggtaactccagaccgaaaataggttatgtgaagtaaaacaaaataaattgactaactttgtggctttaaactgaaaacgataaaaaacgattagatattatggagtacaatttcagagaaatcgagaaaaaatggcaagaatactggattgccaatggggtttataaagtgaaggaaaataaagataaacccaaatactacgtgttggatatgttcccttacccatccggtgcaggactacatgttggacatccgctcggttatatcgcttctgatatttattcccgtttcaaacggttacagggatttaacgtattacacccaatgggatatgatgcttacggtctgcctgcagaacaatatgctatccagaccggacaacatcccgaagtaacgacaaagcaaaatattgcccgttatcgtgagcaaatggataagataggtttcagctacgactggagtcgtgaaatccgtacatgtgataaggaatattaccactggacacaatgggcatttattaaaatgttcaacagttattactgtaacgacgaaaagaaagcattacctatcgaaagtctgatcgaagcatttgaaacagtaggtacggaaggtctgaatgttgcttgcggtgaagaaatgcaatttaccgctgaggaatggaaagctaaaagcgataaagaaaaacaagctatattgctgaactaccgtattgcttacctgggtgatacaatggttaactggtgttccgaactgggaaccgtactggctaacgatgaagtagtgaacggtgtttccgaacgcggtggtttccctgttgagcaaaaaatgatgcgccagtggtgtctgcgtgtatctgcttatgcacagcgtttgctggacggactggatacgatcgactggacggattcactgaaagaaacacagcgtaactggatcggtcgtagcgaaggtgccgaaattcaattcaaagtgaaagatagtgatctagaatttaccatctttacaacccgtgcagatactatgttcggtgtaactttcatggtattggctcccgaaagcgaattggttgaacaattaactacacccgaacaaaaacaggaggttgatgcctacttggatcgtaccaagaaacgtacggaacgtgaacgtattgccgaccgttctgtaaccggtgtattcagcggttcatacgctatcaatccattcacaggtgatgcggtacccgtctggatcagcgactatgtattggccggctatggaacaggtgctatcatggcagttccggcacacgatagtcgcgactatgcatttgcaaaacatttcaacctgcctattatcccgttgatcgaaggttgcgatataagcgaagaaagtttcgatgccaaagaaggtattgtctgcaattcaccgagaccggacgtaactccttattgcgacttgtcattaaacggcttgactgtaaaagaagcaatcgccgctaccaagaaatatgtatccgaacatcaattaggacgtgtaaagattaactatcgtctgcgcgatgctatctttagccgccaacgttattggggtgaaccgttccctgtttattacgacgccgatggaatgcctcagatgttaccattcgaagcattaccattacagttgccggaagtggataaattcctgccgacagccacaggcgaacctccattgggacatgcaaccaaatgggcctgggattctgtaaacaaaaaggttgtagaaacatccaaaatagacaataaaacaattttcccattggaactttgtactatgccgggctttgccggttcttccgcttattatctgcgttacatggatcctcataacaatgaaggtctggtagataaacaagtgaatgaatactggcgtaatgtagacctgtatatcggtggaacggaacatgctaccggtcacctcatctacagccgcttctggaataaattcctgtatgatatgggaacaatctgcgaagacgaaccattccgtaagctgatcaaccagggtatgatccaaggacgttcaaacttcgtgtaccgtatcaaagatacgaatacattcgtatccctgaacctgaaagaccagtatgaagtaactcctattcacgtagacgttaatatcgtatccaatgatatactggatgtcgaagcttttaaaaactggcgtccggaatatcataatgcagaatttatactggaagacggtaaatatatctgcggatgggctgttgaaaagatgtctaaatcgatgttcaacgtagtaaacccggatatgatcgtagacaaatacggtgcggatactttgcgtctgtatgaaatgttcttaggtccgttggaacaatccaaaccctgggatacgaacggcatcgacggtgttcatcgcttcctgaagaaactgtgggctttgttctatggtaacactgaaagtttgcaaatcacagacactgaacccacagctgaagaattaaaatcattacataaactgatcaagaaagtaacattcgatatcgaacatttctcttacaatacttctatcagtgctttcatgatctgtattaacgaattaggcagcctgaaatgcaataagcgtgctatcctggaacaactcgtcatcttacttgctccgtttgcacctcacacagcagaagagctatggcatgtatgtggtcacgacacaactatatgcgatgctctatggccgcagcacaacgaagagtatctgaaagaaaattcagttacttacgccatctcattcaacggaaaagcccgcttcaatctggaactcccggctgatatgccccgtgaagaggtagaaaagattgctctcagccacgaaagttccgctaaatggatggaaggcaagactcctaaaaaggtgattgtcgttccaggtaagatcgttaatatcgttatctaaatgagaacagctcagttttataaagtatttttttctatacaggattatctgatgattctgctgggaaccattttgtatggtttcggattcaacgcatttatcctgtctaatgaaattgttaccggtggtgtcagtggtatctgtgcattgatattctttgccaccggaggcgccataccggtatcggtttcttactttgttatcaatgtagtcttactattagccgctctaaagattttaggacttaaattcctgataaagacaatctttggagtattctctctttctgcttccctgtcattttttgaatggttgctgaaaggaaatcctatactgcatgatcaaccgtttatggcaatcatgatcggtgcactcctttgtggtgccggattgggactggtattttctgctaacggaagtacgggaggaaccgatattatcggagctattgtaaacaaatacaagaacatatctatcggacgtgccttgttgttctgcgatttcttcataatcagttcttctttcctactcttccataatgtggataagatcgtattcggttttgttgaaatgcttatcagcaactatgtcctcgacatggtactaaacggtaaccgtcaatccgtacaattccttatattctcacaaaaatatgatgagatagccgatcgaatcatccatgatctggatcgtggatgtactattctggatggtgtaggaggttattccaaaaagccagtcaaggttgtcgtattgctggctaagaagtcagaatccgtatccatcttccggctggtaaaacaaatagaccaccaggcattcatttcacaaagtatcgtccgtggagtatatggagaagggtttgaccagataaaaacttaacggaatatactcatcgaatcatttatatattcagaaccgattcctcctgcatccagtatactatggaacaggtaatcggttctgaatttttttacagaattctcttttgctttcgtataattatccggatacgcttctttatatttatcagacatccaaaccatacaagctgcctgatgaacaaaaggcgattcgactgcatgtaaccaaataccatcctctcccaaagcttccccatgatcagactgatagataagaatagctttctcatcctttaaacgatttatcagattagacagaaaataatctgtataaagaatcgtattatcatacgaatttatcatttcttcttgtgtacaggaagagataattttactgtttactgtcggttgaaaacgcgcaaattcatctgtaaaatgagaattataccaccaatgagaacctattgtatgtattacaatcagtttcttctttctatctacctccaaagcattatcaaaaaggggtaacaagtctccatctacccaacggtcgaatacaacataagaagatttatttatattgacatggaacaatgaatcacattcattcataaaatacacatatgtatcggcagcctcctggttagctaaccaaacagtgtaaaaatcacaggctttaaaaaaactaataaaagacttttcagtataagcccttgaataatcggtactatcagcacgagtcaatatataaggtacgctactattcgtataagtctgctccgcataaatgaaaggataagaaataatatcttcttttgataataaaggagtagtatttcgctcatatccattcaaccccagatgatccggacgaagcgattcacctaatacaaaaacaaccgttacctcctcatcactacattgtgtcccttccgtcaaatctattctttcttcactaatcacctgtttttcttcccaatatttcataaaagtataataaatattgaagggtatacgttctgatataggatattttatagcatttatacgcgttactgaaaacaaaagtaatccgcctatcagaaccggataaatagacgagcgaatagtaacccgtttaatcctgtaaacaacaaaagctatagataatccaaaggttataaatacaaatactaacaaacctggtgagaccaggtcacctgatgtacgcatatcattttgtaaagctgcatctaataacatgggagtcaaagttgcattcatggtaaaacggaaccaggcaagcaatgaactgagaaatgttagtaatgggaatgttatagcaaatactattttgttagcagctaatagaatagttataaagaaaagcaccattgttattaccgaccattgaaaagcgataataagtaggtcttttcctgtgctgaccggtatggttaggaagtcagccgatgtaaaactaatagccaggaaaaaagtagcaactaaagaaaaaagataaaaatgaacaggcacattcttcatattgataatgaattgatatgtatttttgtgcaaaaatagaaacaatacattgataagcagtatgaaaacattagtatttgcaactaataacaaacataaactggatgaagtacaaaaaataacatccggcctggtaaatatagtaagtctggaggatatcggttgtcatgatgatataccggaaacgagtgataccctggaaggaaatgctcttcagaaagcccggtacataaaagagtattatggattcgattgttttgccgacgatacaggcctggaggtggaagcattaaataatgcaccaggggtttattctgcacgttatgcaggtccgggacatgactcggaagcaaatatgaataaacttttacaggaaatgaataatatggaaaaccgaaaagcttgtttccgtacagttattgctctcttattaaatgggcaggagtatttatttgaaggaattgtaaatggtcaaataacgaaagataaacgaggtgcaagcggattcggatatgatccgatctttgtaccggataattacacacaaacttttgccgagatgggaaatgatattaaaaatacgatcagccaccgagctgaagctgtaaaagaattaagtgcttttctatctacattatcagaataaattatgagaagaattatatacacttttatatttatatacgttaccgcttctaccatcattgcccaaaaaagtgttggagaatggaatacttacctggcgtataacattgcaatgaaagtcgcagaaggtaataatcatgtattcacagtagcggacggctctctatacagttatagtaaagaagataatagcgttaagcattataccaaacaaacaggacttagcgacagtgggatagatcatattatcttcaatcctgaagtaaatacattattgattacttacagcaatggaaatatagacctgttgggagattatggcatttataatctttcttatttacttgataattcgaatgtaacgaataaaaccattaacagcatatacttatataaagaatatgcttatctggcaactgatttcgggattattgtccttaatatggatccgaataagaaagaaatcaaagatacttacaaattgaacaagaaagtcaattccgtaactatcaacgacaattacatatatgcagctacttcaagtggcatattgaaagcctcgttggatgcaaacttactagattataatgaatgggattcttatcagttggctccatctgaattcgaattcgatcaggacagtatcagccagatatgtttcttccagaattccttatgtttttttgctaatcaaaaatacaataaaggtatttattatgaacaagcagataaaacagtcaaaagtctgttgataaataatagtttgactaatatggtttttcagaataataaattgatgccatataccaacactcaattatacatatattcttcattgacagaaagagacgtcatcaatgctggaattgtatatggtgtttcttctctcaaagatcccaacacattttggatagcttcaggagtcaatggcttaaaaggtattcagaaaaaaaataatcaatatgaagtcgttgtagaaggattgaacgatcaaacgatatatcccaaacgtaattataattattatatgaccacatacgaaaatcaattatatattgttggaggagatcgttggaccgatagaaaatttagacaaggaacactaatgatatatgataatgaaaaatggttcaacttagatgaaactactatcaaaataattatttctgatgaaaaaaataaaattgaatatcctagtgactatacaggaatagccattgatcccaaagaaccctcacattattatgtatcttcttacggagaaggtattattgaattcaaagacaatcagtatgttcaattatttaatcataaaaacagtacactatctacaatctatccaactggtggagacagagcacaacagagatatatacgtattggaagtgtaactttcgataaaaatggcaatctatgggctactaattgcggagtacaggatgtactcaaagtattgaaagcagatggaacttggacaagttttaatttttctaatacagataattttacaaatgttcctttggcagataaaataacaatcacttccgataatcgtaaatggataaatgttccctacggatataaatctggtatccttatctttgatgatggcggaacaatagatgatacaagcgacgaccaagctcgttttatatcaacattcagcgatatcaacggtacgattgatgccagcggttacttctgcattactgaagataaaaacggacaggtctggattggaactaacagaggtccgatttactgtgccaatcccaaagctaaattggaagagataagatgtagccgggttatccgtcccgcagatgaaatcaatgatgttccttacaattttcttgatggagaacaaataaatgctatcgctgtagacggaggaaaccgtaaatggatagctacacaaagttccggtgtatttctggtaagtgaagatggtatggagacaatcgaaaattttacgacaaccaactctcctctcccatccaaccagataaactcattagccattaatcaactgaccggagaagtttttataggtaccgaaaaaggattggtatcttatatgggcgatgcaacagaaggaaaagaagattattcggatgtatatgcttatccgaatcctgttcgtccggaacataacgaccatgtaacgatcgtcggattaatgaatgattcgaacgtaaagatcacggatctgaaaggtaatatcatttatcagggaaaatctgccggaggtacttttacctgggattgccgaagtagaaaaggtggccgggttgcaaccggagtttatcttgtattctcagcaacacccgaagccaaagaaagcgtagttactaaaattatggtagtgaaataagtatttgattggttatctttttggcacctttgtcattcggatggattgcatcgtaaaaatcggatgcttccaacaaatcaaaacaatcgatataagggatataccccaattcttttatataagactgaagagctttctgcttttcagtcttttttgctgatataatatcaggattatacggcatcaacaccagataatatcgaatattctttgctttgaaaaaagaataagactcctctatcaatcgtttccattcatgagttatcctatatgcttcaaacttattttgtttgttttgttcgtccaggccacgctgataaacagcttcatttctgtaagaggcttgagcagcaggataacgcaattcattgtcgatagaactttccggtgcatcatcgtccaatagattacgaagtacgaatgagaatcccgaaaacaaacaattcctggctttataattataataccaatccgatttactcaattcatcatataaaccaggtactaacaatttcgtccggtcatccatcttataaccatacatatgtaaagctacctgattaggtatatccatatcgaccggcttggacagaacatctatatcgagacactggataaccgttttgacagaagacggcaatgaagaataatataaagcactttcactcagcatctgtccggtcgaagtaaaactatatacgacaggatgatcgctcaactctttttccaacatatagccatctactccgctcatccccctgctattaccgaaaataacaatctccggaacttgtttcggatcttttattgtattcagtataagtttagtacgggcataatcattaggaagcatcctgaagaagtaaggagttaccccattcaaaccaaccatcaaaacgactataaataatagaaaaaagaatatcctctttatctgtttccctgtcagttccataatttcttagaattgaaaataaataaaattagaagaatcagcaccgaagaaataaatcgaaaagagtatgccggcataaattgaataccggacaaataaactttgtatgttctgtatatccaatccgaaaggcttattcctgttcacccattccacgactaacagaatacctataaataccaacgataacatagccgtcacattattagctccgctaactttgggaaccctcaacaaagaaggtgaaaatatatcaccgatataattaaacgcaatagagagcgtttctgccctgaacacaatccaccccaaggtaacgaacccgaaagtgatcaacattgaaataacaggaggaaacataggtgaatcaccctgtttctttttactcaataataacaaaggcacaaataatagtccatgatagattccccaggtaatgaatgtccagcttgctccatgccacaatccgctcaggaaaaatataaccagaatattacgtatatgcttatattgtccttccctgctaccgcccaaaggtatatatacataatccacaaaccaggtattcaacgatatatgccacctgcgccagaattcgataatatttcttgaaaaataaggataatagaagttttgcttcaatgttataccaaataatttagctgtcccgatagcaatatccgaataccccgaaaaatcaccatatatctggaaagcaaataaaaaagctcccagaaccaatgtactggcagaataattcgaataattaccgaatacatcgttcactaccagtgcacagttatcagcaatcaccatctttttaaaaaacccccacaagatctgacgcataccatctacggcatagtcataagtaaacttacgcggcttataaaactgaaccagcaaattggtggctctttcgataggcccggcaaccaactgtggaaaaaaactgacgaaagcaaagaaagccactatatctttagtcggttccaaccttctcctgtatacatctatcgtgtaactcaaagcctgaaacgtataaaaactgatacctaccggaagaatgatctgcaaagtcgatttgtgcaaagtaattcccaacagggaaaaaacttccacaaagttatcaacaaagaaattaaagtatttgaagaatccgaggataaccaaattcaggaaaatatttatcccggttatccatttgcatttcttttgtatggataaggaatcttcggataatgaatcgttgccttcccgtacttttgcaatagcaacaccactcaaccagctgcaaaaagaagtaaaggcaataagtataagaaaacgccagtcccaccatccataaaacagatagcttacaatgacgataaataagttttgtaattttatcttcctgttgaaaacaaaccaatatagtaagaatactaccggaagataaatcagaaactctattgaattaaataacatcttgttctgttctatgaatgatgggagagcctatatgctacaaacctaatttttcagaaatctccaacatcttacggatcggtttgatagccttcttctgtacttccacgtcgacaaatatctccggcatttcaaatttcaaacagttatacagcttttccatcgtattcagccgcatgaaattacattcgttgcaagcacatgtactgtcgttgggaggagccggaataaactctttctccggactctttttccgcatttcgtgaataacaccgctttccgtcgctacaatgaactgtttcttatctgacttgatagtgtgtttcaaaagagcggcagtcgaacctacgaagtctgacacctgtataacgggttgtttacactccgggtgagtgatcacttccgcatccggatactgtttctttaattccagtatcttttccagtgaaaattgttcatgtacgtgacaggcaccattccagagtaacatattacgtccggtaatactgtttatgtaattacccaggttccggtccggaccgaagatcatttttgttccttccggaaaactttcaacgatctgacgggcattggtggaagttaccaccacatctgttaccgcttttaccgcagctgttgtattgacatatgaaataaccacatgatccggatgttgttttacaaattcagcaaactcaggagccggacaactatcggccagggaacaaccggcattcaggtcaggaaccaatactttcttgtccggacataggatcttagccgtttcacccataaaatgaactccacagagaactataatatccgcagttgttttggcagcccattgagccaacgccagactgtctcccacgaaatctgctatatcctgtatatcgccggtctgataataatgcgcaagaataacggcattcttttccttacgcagtttatcaatggcttccttcagatctatgcctttaggtaccggtgcatccatatatccgatcgattgatttgtcaacatagtttatctattatattattcttagtttttaattccaaagattataggatgtatataatatcctgttaaaatggttcatattttaatcgccctttcctccttatgaggatataaatagtatatcaacaaagttatcatccacttttattactgataatctttattttactatacttatcaactctatgttgataatgtgcaaaggtaaaaactttatttatttcagccatctaaagcagtgcaaaacaatctttaaaagaaaggggaaagaagcttccctatttattggccgtcataataattctcctatccgatatctcaatcgagaaaagcaagagttttttatcagcacttaccaaccacctgttcacaggatatccacacaagattcacacacatacgtttcacctgtcacaagctgtacagcacattggcatacagacagttgctgtgacggcagacgtttcacatttaaaaaatatgacttttcaaatgttaagacaggacttttgtctttaaaagacgggacatttaaaaacaaaagacctgtctttttcagccggtgcttaccgaacctaaaagcagtgcctatcggtttaccgcccggtgcttatggaacctttgtaaagacgtgtcaccataaaggaattacattcaaataaatagaagccgtgacgggtgaaacgttattgcaaagataatcctttgtaaccgtatccttccgtaatcccctcttcttagttatccacaattatatattatattaatattaatctttaatttaaaaataaaatatgatgtatatgatatcctgttgaaacagttaatacatttttgttacaatatttgtttgaggagttattaaagtatatgaaccgcttatcaagacgatactaacagtataaaatatagctttacttctgttttccttttatttatagactttattagttttatgttgataactggttgtgtgaaaaagtttgttcctgttgatgggtgttgatacgtgtataactgctgttaatagctcgtaataaataatgggttataaatgttgcgtgtttgaaatgggaaggagtataagtaagtatttgaataaagcaagaactttttttcattttgtgttcactacttatcaataccttttcaacggcatatccacattaattagctacttttgcaggcaaagaaaagagctatgcgtaaactgaaaataacagaaatgaaccgcctcaccccggaggcttttaaagagagtaagaagatacctttaattgttgtgcttgaccatgttaggagtctgaataatgtcggatccgttttccgtacgtcggatgctttcaaggtagaggctatttatttgtgcggtatcacggcttgtcctcctcatgcggagatccataagactgccctgggagctgaagatacggtggaatggaaatattttgaagatacacacgacgctgttgataacctgaagaaacaagggtatactgtttgtgcagtagaacaggcagaaggtagtgttatgctggataaactgctgttagacaagggtaaaaaatatgcagttatcatgggaaacgaagtaaaaggtgttcaacaatctgttgttgataactgtgatatgtgtattgaaataccccaatacggaaccaaacattcattaaatgtatcggtaacgacagggatcgttatctgggatttctttaaacagttatcagattaatcctctttcaaccataataacgacccgttcggtcatggcatcttttcctttcgggtcgtattccgatttcaggctggctccgaacataccggcaaacaaattccagaagcctgccctgaaacctcccaggtaagctttcaacaggttataacttgattggttacattccctgtcgatcagtttgataagtagtttaccttgtgagaatgtcagctttttaagttccggtttatattctttgaacaaatccttttccatacgtttcagatgttcctgacgggccttgtcattaggaagcgtttccatatattcataggtttcgatcagggtttcatataccattttagcataaggtaatgtgcgttttacgtctcgaaccagtttattatacttttgttgttcccggttattcttgaaacgcatctgaggaaaaacaaatacttcctggagattgacaacagcaatggtatccttcccatccagataagctctttgtactccttcgggaagtgtgtttattttcagtttctgtgcctgaccggctgtgacacagagtaaaaacaaaaccataatcttataccatcttactttcatcataagctacaaaagtaggtgatttaccgatagtctgtaccggttttacagaatttgactaattatatagaaatgatgatttacttgttaataagttgtcggattaataagaatcgttatatttgcagcaattcttattaataacaaaacgaattagctatggacattgaatattattagtagcattctatatgtgcttataaattaacaaccaaaatatcttatctatgaaactattgattctatccctgttatcgggagttttcccctgtttgtatgctgttaataacttacgtttgcccgatatgcgtagcgtgggaatgggagaatgtggcattacccaatcttttcttttcaatccggcactgatcggtttggaaagttttaaaagtttagatatcagctattttaatcgctacggactaaaagaactgggagttattaacctttcattttcttatcctgccacctttcttccaatcggtgttaatatctcttctttcggttatgatcgatacagggaaagtatgttccggcttttcctgggaaagtctttgaatgaaaaatggaatatcggtataagtatccagtattcaataatacagacagagttgacagagagacatccacagtatttgtcgaccgacatcggtattatttattctccggttgaaaagttgttgattggtatgttaataatggatttaccgtctgtcgctattaaaaaggaagatattgatactaactattttatgagttattctatacagataggttttcaatgggaagtaattaacagcctgttgatagtaggaaatctggagacgaataaacagactactttaacaggttgtgccggcttggaatatcaattatataaacagttttatgtacgggcaggaatcaaggcaactcccctcctgcctactcttggtgtaggatatcgcttttcctgtttcactgtagatgtggcaactgtgtatcatccggtgttaggtattagtacagggataggtttgaagtattctttttaaattatataactatgaaaaagtcgtttataactctgttagtatatatgttgataaacagttataatattaatagtcagaatatttactctgttgataagtggatggaatacatagaagaaatggcttccgaaacagatgatgatgcccggattgaaaatctttattccgatctttcatatctggttgaacatccttttgaattaaacagtgttaccagcgaagaattaacccgtctgccttttttatccgatctgcagattgaacagattatctcttaccgtaaaaaatatggtaaactggttaccctttatgaactgaagaatattgaagagttggattttcatacaatatctttgttacttccttttgtttatatcggagagatttctgttgataaacgtccttttactgttaagaacatgttgaagtatagttctaatgaattgcaaatcagatatgatcaatgttttcaacagaaaaaaggatattgttcatatccggatagtattttacagcaatatccgaaccggaaatatctgggtgaacctttccatcactctcttcgttattcttatgcattcgatgaaaggctccggtttggcattgtagcggagaaagatgccggtgaacctttttggaatgagtatcataaagggtatgattattattcggtatatttatttttgaaagatataaacaaatggttgaaaagctttgcaatcggtgattacaaagtttctttcggacaaggcttggtaatcagcagtgatttctctccgggccggagttctattgtggctcaggcggaaagacgtacgaatggatttcgccggcatttttcaactaatgagaatgattactttcgtggagtagcttctaccgtttcgattaaagatttggatattagtttcttttattctttcagaaagctggatgcgggtgttgataactatgaagtaagttcgtttaaaaccgatggtttgcaccggttggaacgtgattggaataagaaacatactgttcctatgcagacatacggtggaaatgtacgctatacaacttctaaccttgccatcggtataacagccctctcctattcttttggaaaatacgatatacaacctgatccgaaaccttataaccttttctatttccgtggaaacagtaatatgaacatcagtgtggattatatgttgaaaacgaataaacttaaattttatggtgaaacagccttgtcttcaaataaagctgtagctacattaaatgcgtttcaactaacgcctgtttcttatttatcgttattgctgcttcatcgttattacgacaggcgttatcaggcttttttcggaagtgctttcagtcagaattctactgtacagaatgagcaaggtgtttatacagggatgcaatggacaccgttcgcccattttaaattatcgttgtatgccgacttatttcgtttcccctggttgaaatatggaatagattcaccttcttccggacaggaatatatggctcagttggattataattcaggaaagaattttagtacttactttcgttataagtacaggaagaaagaaaagaaccagactgtagagaatgaatcgacacaaagtgtactgccttattctcaacaacgcttccgtcttcaattgttatatggtttacaacctgcatgggtgttgaaaacatctgcagatgctgtttattacgatgaacaacagggaaaacaaagtcttgggtggatgatttcacaaagtataggtttgaaaccctcttcatttcctcttcagtctgatttttatattggttattttcatacggatgattattacagccgtatcaattcgtatgaaaagaatattctttatgctttcaatatgccttctttttacggaaaaggaatcaggttatctttctcttttcgatggaacatactggataaactatctctttctgcaaagctggcccatacttattatgcagatagggatttgataggtacggatcaggaagaaatagaaggacataataaaacagatatatatgtgcttctcaggtataagttttgagaatttataatcttttgtagctttgtgtccgtaaaactggtaatattgcggtgttctttgttatataaagaacttaatggataaattatatattatgtcaacgattctttttgataaaatagtgttcggtccgatacacagtcggcgtctgggcgtttctttgggtatgaacctgcttcctgtcgacggtaaactttgttctttcgattgtatttattgcgagtgtggtttgaatggtgagcgtcgtacacgcaccaaactaccggttcgtgaagaagtaaaaaccgccttggaagaaaagttattggctatgcaaaaagaagggataactcctgatgtgatcacctttgcgggcaatggagaaccgacgatgcatccggaattcgaaggtatcatagaagatacgatcgctacccgcaaccgttactttccaaatgctaagattgctgtactgtcaaactcgactatgcttcataaagagggtgtattccgggcattgaataagatcgaggataatatacttaagctcgattccgtactcgatagtcggatacaacaactgaatgttccgaattccccggcttttacatttgagagattgttggagcaattatgccgtttcagtggaaacctgattatccagaccatgttcctgcgaggtgaaatagatggtaagtcggttgataatactactgaagaggagataaaaggttggatcgatgcattgaaaaaaataaaaccgaaacaagttatgatctataccattgatcgtgaaacacctttgaaaggacttaaaaaggtatccaaggaggctttggatacaatagcagaccgggcccggaaagaaggatttgatgtaacagtttcctattgattgtatttacttttctttcaagagaaaagtaatattaatctattttaatagtgcggatcgttttaacctccttatccgtaaccagcttaaagaaatagacacccgggggaatatttcccgcatctatccattctgtcggattatttattttccggatcatttttccgtcggcggaataaatatctatgtatttaatctgctgataatttattatatgtatccggtctctgaatatggcaggactgatatttatctcttccttagccggtatgctttcagaacttacttttacttctgccacagccggggttgctttactttcctttaaatcataaagagctgaaacactgtaattatgaataccggaaatcacatttttgtctgtaaattgtaatgttgaagccggaactgttgcctgttttatctgatttttatagatgttatatcccgtgacaacagggaaagccgtaataggttgtgttgtcgtagaccggagctccgttaatttaccttcttcggaagtgatagttgcggagatgataaaattattatcattttcttcatttagtaaatattcccatttgtttccgtcgaacgatactaaattaccttttccattaatagccggtcctttatctataaaagcgggataagccgatcggttatattttctggcatatatggaaatgatcagttcctggccggcatcgatagtatacggagtttttaactctaccgtattcgatctgttagctgtcgtattgccaacttcctgttgatatgtacgttctccctgcttgatataaatagcatagttgacattgtaagcaggaatgaattttacattcgtcagtgtctttttatgcatatttcccaggtcttcaggttcccaacgttgaccgaaataaaaaggagaactttggtatccgagctgtttgtatgagctttgtgttccccacccaattgtttggctatatacgggagcactccactgtataaggacatctttggaagaaacaaccccggctgttacatctgtcggtgatttgtaattgatcaggtttccttcttctcctgtttgcgataaacccggaagcactgtggtgcccgtgttcagaggatccagccatatatccatccgtccggtgtcagcctggctgtatttatcccaatgataagataatttgccatatagattattaccggttgtctggcgacaggtggaatttccgccgcttaatgttccgactatctgtttattctcgttgaaaagcggtgaaccggaagagccgccttctgttatggaatgtccattgagggtcttatcgaaaataacattccagtgggcatcaggagcgccggtagtattccaggtcattgtttctaccgggcgattgccaaatgtggatattttcatataatcacctgaaggatgatgaatgtttactcctgatgaagcaggtagatcacttcggtcccatccgttgaaataaacattataatcctgagggatcttcccgttcagcaataataataggccgtcggaacctccatctatcggaatactcacgatgcggctgcacccgaccattgttttatgatcggcaaccggtgaagtgctttcacatccggtctgttcgaaatgaaaatagaatacccattggttcagatcctctactgaagctatttggccgttatcctgatcttccgtacaatggaaagcagataatatataaggtttcatatctttagccgtattatttatcagggaaccggaacaaagatatcctgcttttcctattttttctaccatctggcaaaccccgttcttttcggtttgccactcctctccttcttcacaatttatattaaccatacaggaaccggaagttcccggaccggtatttcgtaaactgccggatacggttaaatgattgtatccatagcctacctggctaatggctattccggctttatcaccggatgcagctggttcatattcaagcgtaagatcatcaccagctacaaattctgtggcaaatattttttctcccggattgctttgtgatgtataggctcccaacaggtgagttttatcagcattataaataaatagttttccgccttccggaatgtagaattcgtcgtaatataacattaaggcaattgctccttttgcttgcagatggagctgccataccttttcgcctccgggcagtgtgatccacttgccggaattatcgatattcaaatccgtatctattaaagtagaaacagttaaaggtgccccctggctcacccgccattcgtcgactgcaatcaggtcttccacactgaagtttacaggaatctgaacagccggctgttcacttttcaacatatttcgataattgaaactagccggtttccctccttcgcttatctgcgatttcatttcacctgcatgaaacaggaaaagacagataatatttatataaatgctatgacggaataacttgttacaattcattataatttgatatagatatgtttcttatataaccaatatcccggaatccagttcaatatgacaaaaagaacggcccataccagcgaacctccgaaattaccgaacagaggcaccagtatatcggtataaacataggatgttattccacatttatcgaatatagtggccaaaacagcggcttgtacataaagatataacggattgatcccgaacgactcgaagaatagtgaccatttctttttaccgttgatatcgatgatccagatcagtaaggcaaggaacaatgatccgaacccacaggtggttagtacgaatgtgctgctccataattttttattgatcggacaaccgtaacttaacaaaaatcccaggaacaggatgatcgctccgaatataaacaggttccggatgatctgttcattattttttttactgtccagaattattttaccggcataaaaccctaacaggacatgtccgatgctccccacacaacttaacagtccttccggatcgaaagctatacgtgtcccgtctgccaggtaatcatggtacatatgtgtattgccaaacaagagacggtctacaaccgcaataatattgtcttccgacagtgtcgtacttcctgtgaaagcaagtaacatccaataaacgatcaggataccggttgccgtttgccagatgtatttgtgattaatggccagtccgatcagtgaacctgcaccataagccagcgctaatcgctgcattactccgaggatacgaagattctcaaaatgagtgaatccgttgtaacatatatgtgagaataaatttaatccgaatccgaccaggaagatcaacacagtgcgcttcaatattttcgtaacgctttctttggataatttgaaattgtattttcgtaatgaaaagaacatagaaactcccatgatgaacataaagaacggaaataccagatcagtcggtgtcaaaccgttccataatgcgtggtggagtggtgcatatacataatcccaggttccggggttgtttaccatgatcattcctgcaatagtaatacctctcattacatccagtgagagtaaccttcctgattgtgtcataacttagatttttgggttgtagatgcaaatgtaattaaaaaacaacagggttatgttatttgtaaaataaaatactaatgttcagtagaatgtatcctttgttttagtatatttatacggcatacggcactttttaatggctgataattgtcagccgattggctcatatttatcaaccatacggttgacaattgtcggccattcggttgatatctatcaaccactgattacttcggcatgtaattgaatttagtatgtagggtaattgaaatctcttcggctatattgtgaatttttgttatatattctttgtcgttctttttttattgactaatattgcgatgttataatatggtatcctatgaaaaatatattctacctgttatttcttttgattacgttttttacaagttgtcgaaatgaatctacagaacgccaattgataaatgacgctgaagctttgttagagataaaaccggatagcgcttatctgttgttggatagcataactatggctgacaacttgagtgataagttattagcccgctggtgtatgttgtatggaaaagctgccgataaagtgcatgaagacatgccatatgtatctcaattattacgtgcacgaacctggtacgaaaaatatggaacaccttatgaacaggcacagatcggtttattcttaggacgatcatacgtagaagatagagaatatatgaaagcgatggagacttatgcacaggcgctggaagtagctgaaagggcaaaggaatataatgtggctgggtatatttgttcttatatgggagatttatatgaattgaaaggattctttcaggaaactcttgataagtataatcagtctgctgattattttttgaaagccgataataaacgaagttatgcattggcattgaagtttatggcacaaacattggcgtttgaggactcttgttcattggcattggaatatttattgaaagctgattccattgttgtttgtttacaagattcgggggccatgtcttctatagaaaatggattggggaatgtatatggtttgatggggaattgggataaagcagagtattatttattgaagtcattagaaagtaatgtgtcggatatagcacctagttattctgctttaagtgaattatatatgagtattggaaattttgataaagcacgtttatatttggataaatcaagaatacctacaaaaaatcagttgactttgatagcatctttatatacagaatatgaaatagaaaaaaggtgtggtaatatgaaacttgctttatctattttggaacaatatgtagaaaaggttgattctatttataattcaactattcatttggacatattagatgcagaaaaaagatataatcatgtgatgttattgaatgaaaataccaagcttaataataacaacttgatagcacttattattatcattatcgttataggtattggtttgttactatgtcttatcgttttgtattattacaataggaaaaacaaaatgctatatgaccaagaagttaaactaaaagcaaatgaagaaaggatatctgcattgtcttatgaactggaaaaaaagaaaaaggaggtgattgtacaggaatcaatacatgatagtgaatctaaattaagttctttaaaagagaatatatcaaacattgaaaaagaattgaatttgttaaaggatgaaagaataaagaactctactattgtgaaaaagataatcaaattatcttctaaggtcattgctggaaataaagaacagttattaacaaatagagattggcgtagccttatggaattgattaaccagacatatcgttcgtttgatgaatttatatctgataacccctatggattgacccctacagaaatacaatattgttacctttcttttctgaaattggatataaattcagaagccattctattaaatataaatccggaatctataagtaaacggaggttgcgcatacgccagaagttaggttatgtggggactgaggtgttgttttatgagtgtatttgtaaatgtttgtatattaggtgattaatatgttttttgtccatatggcattgttttaatctattgattttcatagggtgattgtccttgtgtatttgatagggtaggagttttttgttattgaaactatctatgtttgcagcggatttaaaaacgttgcaagtatgaataagtatttcagatttttagttacaattatttttctaataatgttcactgtttctgtatacagtaaacaatatgtccatttgggaggaagatgggataaagttcaaagatcattaattaatgatttacctatccaagcctgggtagaggatggtaacgaacccttgatactattctttaaagataatttaggggatgtttgtgtaacagtatccgattcatccggtactattctgtatgaccaagttattcatacaaatgaatttgcttctattatgatacctgtaaaggatatggaaggagagtgtatgctatctattactgatggtaaaaataatattttcggacaattttctattaattaatcatataaattatagtttatgaaaaatttaattgtatctattggtacatgtttactttcgtgtgctttattttcatgtaatgaaaatactatgttagaagaggtggataatggaggagctaatccacaaacaaaatccgctgtcgatgcttcttattatgttcaaggagacggtacactctgttttagaagtgtagatgattattttgcagttactgattcgttgattaagctgacagatcaggaattaagtaattgggaagaatcaataggttttgtttcttatagatctcatgtggataaacttattgatgaagtggaagaagcttttaatgaagatgataataacaaagctaacttattgcttactgattattcaaaatatatttatttggatacagacagtatagttaaaccttatatcagttcaaaaacttatcagtctattactaataaagatggtgttttttatttgggagatttgaaaaatgtagtagatgatacttctatttatgcagttggaaaaggacgtagcgtatctcctaagctatcatatgtaatggcaagtaacttaagaggtttaaatgatctcgttcaatataaggaatatgactatgaaaaggaagatggaactaaaaaggttatttcatcttgttccttagtaaagaatatagcattgacagatgttcagggaaataatcattcctgtgtacaatttcagatatttgttgatggtaaaagacataaaggacactggaaagattatacgacaggatattctgttatggaaataacttgtagatttaaagatatacctttagctgtaaattccgaccagacattaaaatctactggagattatcttttctctcatcctggtaaagatgatgcagatcaatctaaaaatcatacatttgtgtataatataggacttagtgttaagaattatactaatcccattcaacatgctacctgtatacattataaagcactgacttggggtactggtgaggaaggccttggatataactattgtaatggtgattatggtattgatgaaaatcataagaaagggcaatgtgcaaaaaaggtttgtagtgtacattctaatgtacattctggaaaataattaatttttgagtggattctggcaaaattattcttttaggaataggggtattttgtcagaatctgtctttaagttataaatcaaagaaatcatgagaataaagctttacattattttgagtatgctcatttgcatgagcgtggtgaagatgagtgcccaggttcgtttaggagcagaaattggtatgaatgtttcttctttggctattatagctaatggtcataatgtggatgttgcgggaggattatctgccgattatttgtttaataatggaatcacgttacaatcgggtttgtattattcgagtaagggtgcttccgggttgtgggatgggtataattattcctgcgaattgagacaggccgatattcatttgggctatattgaggttcctttaatggtcggttatcgtattccggtaatgagtaatgtttatctggttccttctgtgggggcttattttgcttgtggagtaaccggttatggtgaaattgatattattgtttctaatgaacacggacatggtcgtatctccgaccaatggaataacccatataaagattttaaaaaggattggcttgcagatacagaggtaaaagcttttgatcggtttgattccggacttcgtttcggattgtcgggagaaatttcccgtttcgttatttcttttgcgtatgatctgggattgaaaaaagtttggtctggctttgatacgggtagttataagacttcaacacataagatgaaaaatagaactgcatgcatttcagtcggctataagttcaatttataaaaatagatggtgaaattactacggcagtttcaccatttatctatattccgacttgctatcaggtgggggcgactgtgtctgttgtttcagacggaatagcggttgtgttttgagtcgcttgtttcttattataatattcttctcttttcttattggcgttctgcaccagactggtcacgtaaacagtgaagatcgggaacatcatcatccccagtgcagccagcagtaccgataatatccgtcccgtaggtgtaacggcataaatattcgaacctaccgtcgtcacatccatgaaagcccaccagagtgcatcatcataaccggttacctgtggattaaccttatgttcgatgacaaagaatatcagactggaaaaataaaccgtagccagcaacattgtcagataagatacgaacagtcccgaagccttgttggaagatagccatcctaccactattgccagggcgtaaccactacgtgccaatggaataaaacgtaggaaataggtaatctccggtgaaaattcaatcccataataattgataatatttagataaggaatagatacgatcaggaaaatcaggtgggtttgcagataatataatttacgttttgataagaaaaactccaaaataaagtcggcaatgaaaaacatgcagatccagaactgtatcttcaaatacgatccctgtgtcatgaaagggatattcttgaatgtatcgattgaaattacaacaataaggaacagcgaaagtagcaaaatgataacgtgcaatactccgtatattcctcttttctcataaataatatcattaaaagctgacttcattatgtttaatctttaggcgtttaaatagaaatattttagggtatctaacattgaaaaccctgattttgtttttaacactattctgttaattaacctagtttgacatcttgttgacaaactaacacaataccgatttgttttactgacatattaaagcgaaactaaacaatacaaaattcacatttaaacagtaaaattcatggcaaatgtaggaaaagcagtaaaacttggagtttttactcttgcgattatgaatgttacggcagtagtgtctctccgcggactaccagccgaggctgtatacggattaagttcagccttttattatctatttgcggcaattgtatttttgatcccgacgtcgctggtggcagctgagttagcagccatgttccaggataagcagggtggagttttcagatgggtaggagaggcctacggtaagaaatggggattccttgccatctgggtacaatggattgaaagtacgatctggtatcctactgtgttaaccttcggtgcagtatccattgcttttatcggaatgaatgatgcgcatgacatgacactggcttcaaataaaatgtacacgttagctgttgtattaatcatttactggctggctacctttatttcattgaaagggttgagttgggtaggtaaagttgctaaagtaggcggtattgtcggtacgatccttccggctgccctattgatcatcctcggaattgtttatctgtcgatgggcggtcattcgaatatggacttccatggtaatttcttccctgatttttctaagttcgataacctggttcttgcatccagtatcttcctgttttatgcaggtatggaaatgggtggtatccacgtaaaggatgtggaaaatccctccaagaactatccgaaagctgtatttatcggtgcgttgatcactgttcttattttcgtattgggtacttttgccttgggtgttatcattccggaaaaggatattaacctgacacaaagcctgctggttggtttcgataactatttcaaattcatccatgcttcctggttgtctcctattatcgctatcgccctggcattcggtgtactggcaggtgtgttgacatgggttgccggtccgtcaaaaggtatctttacagtaggtaaggccggttatctgcctcctttcttccagaaaacgaacaagatcggtgttcagaaaaatattctgttggtacagggatgtgctgttactttattgagcttactgttcgttgtaatgccttcagtacaaagtttctatcagatcttatcacagttaacagtgatcctttatctggttatgtacctattgatgttctccggtgcaatcgcattacgttaccggatgaaaaaagccaatcgtccgttccgtatcggtaaacatggtaatggtctgatgtggtttatcggtggtcttggtttctgtggttcattattggcgtttatattaagttttattccgccgagtcagatttctgtcggtagtaatactgtttggtttgctgtattgatcatcggtgctattgttgtcgtagttgctccgtttattatttatgcttccaaaaaggcatcctgggtcgatccgaattcagagttcgaaccgttccattgggaagaagcaaaagtacaggctcctgttgccggtactactactcaaactgccaatacaaataatacaactacaactaatacaacaacgacaaatacaaatacacaatcttagccaatacctctgtaatttctattttacatacaaaaacaagggactgaatctttatgatttctgtcccttgttcgtgtttatctgttttctgtaatatctatcgatacggttcctaagagtccggcagttgtttttccccgatattgtgtcggaacggagagatagtagttggcagctgtgttatgtatcaatacttcaatcttattatcaccggttttaacatgatcagtaatgtcaaattgccagggtgcagttagtttcagacctacttttttgccgtttatccatacttctgcagtagaaatgactttgccgaggttcagatgaactctctggttatttgctatatctttcagttggatgtttttacgataccaggcacctcctgaataggtcgaaataccttctatctgtgaccagtcgccggctgcaatcaagccttccccgcatatctgtctgatcggaccatcaatagccgctccaccggtattaccccattcttcttctatacggatggctactgtagatacccgtttgttcgggttaggaatcgtggcctcataggttatgcaaccgtctgggcgttttcttttgatatccagcagacaggcttttccgtctacccatacttccggtttcccgaaagcggaaaatacgaatttatcgagtcccggagccgatttgaaacggtattgcccgtaggttgcttcctgtgtctgtctgatatcgaacgggagtatcgaacgatctcctctgaaattggtagccaatggtttttcggctgttgcttctttgattatacgtggggtgtcgccttgttttcggatgacgcaccaggttacaccaaaagtatcgtaatgcagtacgatttcgttgagaccttccttcagtaagatacttcccgataagtcctcgatctgttttccattgatatacacggctgccggcttcagttctccgagtgagagttggtaggttcctgcttccggagccagtacattcgaatagagataatagtttttattaccgcttgggttttctacccgttgtgtttctctgaattcctgtttgaattcgcctagcctgatgaattcatcgtgtacggttgctttcagcccatgccatccctgatggccgtaatcgttttctactccccagcgccaggaaaattcgtacggtttccagcggtattctttattaccggctatgataccttctgattttcccggaagattactgaaaatcagttcttctgtcaattcaggagtggcttccaacagcataaagcggggagcgaatgtgaaagtttttgatgtccagccatcatcgtcgaaggaaggagattgccatccgtctgttgctttagaactttgcaggtagcgggctttgtagatgtaagctcccagtatttccggtgtagcaggccagtggaaatcgccgaaccggttatccagggttggtttaagttcgaatgcccattcaccatccagtacgattgtctcctttactttgtgctctacaggggcagagatcgttgctttccggtcaggatcgaatacgaatatatgcatatcctgtttattgagtggcatacggatacaggttccttcgtcggtaatggatgatgcggatatttcccggaaggtcccggtccatggatcccatagttctattccacctgttgcacggaagaaacattccgtatctttaggtacattatatacggcgtagagttctttacccgctattttccggtgcatgatatagggttcatcctgtttatcctcccgggaggtgatgcggaagtcgcgggttagatgtgagtcaagaatatggaggatctctttgttgtctgtggcaataaacacgttattgccggatgttttgaatagtttatcgagtaatgtgtttacacgggtatcattcaatccttttttctctgttgcttcgggtaaatcgccgaggttgatgatgatccctccattttgtttgaatttcagagccttttccagggaagaatgacgaatggccttcatggaagggataataagtactttgaattcttctcctgaaatatgaagtttaccgttctttacggttgccttatccaacgattggtaatccatgaagtcgaaatcgatacctttcttataaagaaaatctcccagactgaaagctttttccacagcatcgttaccgtatccggctactaccggttctacggggtagagaattgctatatcggcccggtgatatccttgtgagagaacataactcagacgttcggaacattcgagcaggggccccatttgttcccaataaggcatgtgggtatgattacatggaggtgcccattcccaccagcctcctaccgtactgtaaaagaaaccatgcaggctgagcaggttctgacccatggcaaaattagcaaagatcgcatcggtaacattagctgtgttactatcccatttactactgtgaaaaccttccagccatactctcggacgttcgtaaaggtgtgcgatggaagaggctactttattttttataatgtctttcgaaaagttgggctgatcgcaacccggtgcctggttccatcgttgggtacggaagtaatcgccgaattcactgacatctcttccgcgtccaccatggtcgcagccgtaaatgaggttacgatcttcgtgccattggtatacggggatgaagaagttctcttcactgagcgataccatgacgtcattataatccagccggattttaggagtgattgaacctatatgagtgaacagggcggcgaggtaggggatgacatcgtatcctttccgttttctgaattcatctctgaagattgaattccagatgcagccgtgcaggttgaagtttagctcatcagaaaaaaagaagttgagtcctcctttggattgttccgggaaacggtcttcgaaccgttggaaaaaatgtttgacataacttttgcccgaaaggggatgcatcgggtcgagtgacggtttttttgcggcactgtatacctgcgttacgatccatttaccttccggtgattgccattgtattttgttgtcagtaaagtttttggtcaggtcgataccggagttctctatgattatattgtctgctcccaactgataggcatataaggaaagcagattttcatggcatgctttctcatagttgccttgaatggtatcactctcgaatttcagttcggctcccgtcaattcaggattttcctttagggcatcatcaacgtaagaaccttgtccgactcccagtgtgtaatcgctgagactgacggtcatattcctttttttcgcttctcccatgaaccagccgaacagatcccaccattcttctgtaaagagggccgggcgggaagggaaagttaagccgtaactgaccccgcctttgtccgagtgggcataatttacttgtaagctggtcactttttttgcagccatctgatccagatggtaggtgaggtgtttacgggttaaagtatcgcccatccaccagtagaaaggtacttcgccatatcctttgggaggcgttgcaaaacctttttttaaatccatagtggcggaacgatccggatgcccgggaggcaattgttttacctgggaagaaagaaactgggaaaaaatacacaggattaaaataaagagttttttcatggttgattagtttatatctgtaataaaacaaaagtagttactaatcaggataataatgtttcaaatatgatattattattatgcattttggctttatgacgagatatttaagccaccttcaagtgtatgttatcttcttgagggtggcttagaatagatattatcttaccgggaattcggtaatgcggagtgtcgtacacccataaggtatcagttcgatcgtttcttcttcaccgacatcgttaccttgttgcgtgaagaaaggaaccggaccggcggaacctctgacgagtgtccaattgtttacccgttttgcttttgttttgatgcgtataggtgcattttctacattccacggataaatgggaacgacagacgatttctctactgtaaaagatgtcttgatctgttcaggcgagaagctacggtgtaataaagcgtagttccagggagaatcggaagttacctcataataccatttgccgtattctccggctttttcgttttcgaatgttttcttttcccatttttcattcattttcaaagcatataccagcgggccacgttcaactacggcactgttgtcgtaccagcggcttacaacgacttccatcggtaattcgacgctcagtacatcgccgttcttccattcgcggttcacacgtgctacagttcccggataggcgtcgatagtaactggttcgccattcagtttgactaccgggttcttacaccaggccggtatacggatgtggaaggggaagaatgcctgtttcacctttttgtcggcgaaggaaatgttgaaacggatggtctcttcaaaaggataggctgtttcttctttgatatttacagtaatgccgttggctacttttgccgatacctgtgacggggcatatactaaagctgcaatgccgttgtcggcagtagcataccataagttctgtacaaacttgggccagccttgatggaggttggaggtacagcaaggatagccggttagttcgccgaacaggatgtcggtatcttcatggggagtggagaattctctccagtcgcgtgtgacagctacctggttcgtttgctgatagtactgacggccggagtaatcgtcggttacctgtgttggcagtgcattataagttacccgttccagataatcggcccattggatgtcaccggttatttccagcatttcttccagcgaatacatcatttctacagccgtacatagttcggaaccagctgtcggttttccgaaacgcagcaattcgtcaccaccccataagccggtaggcaggcctatcgtgttatgaatatcatgaacagccttctttgttgcttgtatctgtttcggatctttgttttgctggtaataaacgatcggctccttgaatccttgtgccaggtttacgcaatgcaagctgtgctggcgtgacaaatgatcctggttcaggaagatatccgtccagttgaatgtctgtttatggataagttcgcccagatcgagcaagaatttatctccggtaatattatacaaccagtagacgatcatcaggttatcgccgccacgttgttcaccccagaatgtccatttgccaagcgggttcttgggtaattcggctaactggtatttgaaataattggtcaggaaaccgatcacgcgggtatcgttggttgccgtataatactgctgcatgattttcaacatgaccatcttgggccaccagtcctgggcattgtcacgctgtaatcccggttcgtagctacggtcggtgtcgggtccgaaatagccgttcggtttttgagaagcaagcgtccattcgatccagggttttactttctctataagagcctggtcattcagaatataagccagtgggagcaggccgtctatccagtacgggcctctttcccatacatcaccgtcaccgccgagccagccgttgcgcagtcccattactttttcgtagacctcatccagatgtccggtcattccgtttttcatccggacgagttgttcctgtatccagccttcggctttgatagaacctagaggaagttctatgtatgttttttgtaatagtggctggcggttattcaaataattaccagacatggattctcctccggcaggtgcagccgaagcaatcgcaaaggtcgcaaatgatgcgaaaaagatttttattaatttattcatggtcatgtagaatatatgaattactctttataatcgatccaaactttcatttttcccgcttcccggttatcccaggtgtagtaggggatgaaagacaacttttgattgccggatacggcttcaatctctttgatgcctcccagtttaccgggttcgtcttttacttcgaaagaggtaccggcagccagattaagatcggcaaagtttttgaaattatcaatctcttccaggcaataaaccagtggaccgcgctgtacagcccgtttgcctacgtcttgttttacacgtggatcagcagaaaccatttcgaccggcatatccatgttgagtgcgatctgatctcctgatttccaatctttgacaatagcatatcctttatctgtcgatgtatttatcggatttccattaacagacaacgtatattttttacaccatccgggaatacggatgcgtagttctttattcaaaggctgtgcagaggtaactgtcagtttaaccagtccgtcccatggataatccgtctcctgtttcaaggtgacttctttgttatccacggtaatttgtgtcgtatttcccatataaaggtttacccacaaggctttatctgatgttccatagatataattaccgatagagggcaggaagcgtgaaatctggcttggacagcaggcgcaaccataccatgcctggcggtggtgatctccttttgattccaggggattgacatagaagaaacggtctcctgccagggaaacacctgccagagctccgttatacatagagcgttccagtacgtccacatatttggagtcgcccgtaaactggttcatacgttggttccagtaaaccatgccgacagaggcacaagtctcacaataggcatccatattaggcaggtcataatcttctgtaaatccttcgttgtgtctggaagaaccgataccaccggtaacatacatattgcgcagaacaacatcatcccacagacgatccaacgcttccacataaccggtatctttcttcagggcagcaacatcggccataccacaatacagatacatacaacgaacagcatggccggaaatatctgtcagctcgcgaaccggaacgatgtcctggtagtaagccggatcccacttgccgtcgtctcctttacttccatggccgtggcctctttcttctaatagccagttggaaaagtccaggtatttttgttctttggtagtttgatagagttttaccaaggccagttctatttcttcatgccccggtacccaatggcgcttatccgggccgaagaggctcatcatatgatctgccatacgcatactgacatcgagcagtttccgttttccggtagcctggtaataagcaacggcagcttccatcatatgaccggcgcaatacatttcgtgcttgtccatatttttccaccgtttatccaatccggtcagggtatagaatgtattgatatatccgtccggttgttgtgcggcggctatcttatcgatccattcgtcggctttcttttccagttcgggattcggattgttgatgaggctataagcaataccttcgagtgctttatatacatccgaatcatcgaagaaaataccggaatgttcaccttctcctttagccgcattgacaaagttttgcatgcgacctgtctggttctctatctgatctatacagacaggtaatgttgccgagatatgtttactcagccgtggcgaccaaaaatggtcttgtatatgaacgtgggagaagtctacctggtcgatcattttgaggggagtgtctgctacctgtttttgttcgctacatccccataacgccaaacaagccagagataatactagatactgtttcatggtcttaatttttaatgttataattcacaactaattctttttaaagaaggagaggaggcaactttctgaccatcgatgaagatggataatccggctcctttgttatatttctctcccgttttatcataaagaacacagatggtccttccatgataggacacattgtccagacaaaaataatcccagtgcccttccggaactaatggattaatatccaatctatttccttcctgtggacggatacctactaatccatttataatcagatcacaaaaggaagaatgattgtaatctcttccgcgttcttccggtaaacgattctgatgcttcagtatagttcgtgatatccaatcccctgtgaaaggattcagattttcatcaatccatggtatctgtgtgtcgttatctttcctcctatactggcttcgtgcgtaaatcgtgagtaaagttacgtaatcacttgaaaatataaagggttggatctgattatttaataaattggatagtccggttaacgtcatagaggtagaataaggccaggaaggaccattccactgacattcatgaccttcgtagaccactttgaattccggatgacattgttctgcggttgtaggtccgtaaggggctaagaaatagcgtgtatccatcaggtatttccatgctaccgcgtattccggatcagccagatcgaaagcccatggtgtatatccgtgaagttcgcggacattctgtaatcgggcatttgtttcctgtggcaatacttttaaaaattcagcatcctgatcccataactttttgaacaggttgttttttagtttctcagcttcttctttgagtgtttttgcttggggatcattatcccattcggcaattctggataagattgcagcttccgcagccatataagaattaatagttgcccggaacccgtttcctcctatggatatttccattccgtctctgttgtctgtctgccagaacaaccccgtttccggtataaacttttcctttttccattcaatgtagttttcttttaactcaggatagaggtctttgagtatttggttgtcacctgttaccagagagtattgatatatagcatctgtaacaggaaagctgtaggaacggagggcaccgcctccttttatccaataataggcataatctttcaggaatttattgtttttcagccatctgccttctctgaaatggaaccaggccggacaacatatgccattgtattttcccgcccaggatacatccggaagaaattcggtaataataaatccatccggtgtctctttcagatgttttctgaatgtccaccagcgaaaatagtagatctcttctatgtttttatccggacattcaaacaagggtatattttcggataagaatttttttgcctggttattggggatatattgtacatatagttcctcatcttgctgattgaagcggtctacatacgaatctaatgttttatggtcaagtatctggcctataaccttgactgaaagtcctgaactgcagaagagcaataaaaaagtaataatatacttattcatgaggacaaagattttttaatctccccatccgataaagacggggagataagattaaataatgatttacagctgtttatttatagctgggattttgttccagattcggattggatgttaaaactttttccggtatcgggaatacagtccggtaatctccttgtggcttatgcgatagccagcttttctttgtgtaaacaccgaagcggatggcatctcttctgcgatgcatttcccaagcgaattcccagcctaattcatcgtacattctaccgaatgctacaggatctgtatttcctttgtctgtgatcttatagttttcaacagaaccatatttatatgatgtgttttcctgcaattgagcatctgttactgttgccagttctggattatctttaaatgcccgtttacggacttctgttactaaagcacctgcacccgattttcctgaacgtaataaacattctgctttcatcatcagaatttctgcatatcggaacaaaggaacgtctgtaccagatgaactttgtgaaccttttgccacttcaaatttgttcatacgataaccttccatttcgctggtataattgccgtcagggaggtcttttgtgtaaatgataggttctcccatcttatcgtatgttccatataatgtgctaccgtcggctgctaattgttctcccattagccagctgttagccagacgagtatctttcacattataagtatcaataaattgagatactcccattgcggaaccacaaccccatggagttgcttctgtttcatattttttctttaactctccatgccaggagaacataaatatactgtttcctccggctagattttcgtcaaaaggaatggtaaaaatgacctctttggaactttctacgcctgttgtccggaatggatctttatagttatccgacaaggcaaatttattactgttaatgatatcgtcgcattgttggatgcaatcattccaatgttcttcgttgatataaacatttgcattcagatatacatttgcaagtaatgcctttgcagcccatttcgtcatacgtccgtaattacctcctccttgttcttcgcttaacgaaggaattgattcctgtaattcttttacaacaaagtcatagatttctttacgggtatttttagccggtaaatccattgatgtcgttgtaactaacggggcttcaccgaagttgtcgcagatttgccagtagtaatatgcacgcattgctctcagttcggccagaccagttgttttttcagcatctgatggagcagggagaatgcctgtttctatttgatcaataattttattacataacaaagctccttggtaaaacaccgaccatatattttttacatggtcttgctctgaattccatgtctgatagtgcatacgtcggtaaacaccaccgtcatcccagcctgaggcattaggaggcattacaatggcatctgcagttacttcctgagcagaaaagtatccccaatggtctgtaaagcttcgtaaatagctataaacgctggccacagatggtgaaaaatcattggttgtataattatatgtttgttcagttatcttagaataaactttttcatccatatcattgctgcaggaaatgatggttcctgagcagcacaatgctaaaaataactttatatagctcttcataatatattacatattaaaatttaacagaaactcctaatgtataagttctcgtagacggataacggttcttattatcaacacccggattcagaccgctgatactaacttccggatcgataccggaataaccggtaattgttgccaggttagataccgtaccatagattctcaaacgtttgatccaagtattgaagttaaatgtatatcctagagttacattgtcgattttccaatagctaccgttttctatataatagctaacgtattgtaattcctgatcggcagccagaggtactttaccgtattttgtttcaaaagcggcacttaatacattacctcttgataacataaccggtgcttcatattgtaaacgaggcatattcaatatatcaaaaccaaaagctccacgcatagtaacattaaaatcgaagtttttataacttaaggagttgttccagtttagataatgtttaggaagaccgttaccgatgatctgtttatcggttggttgctgttgcgaaatcggcttcggattaccgtcggctccttctatgatccaatgaccgttctcatcgatatcgacactcttatatccccagaaattgccgataggttgtccttcctgaatacggtgggttgtcgtttgcagaggttctccggtagatccctgatcggaatagccgcttgatatgaactgatcattagaaagtgataataattcgtttttattgctggagtaattcatagaagtggtccattggaaatctttcgtttgtaccggaatagccgtaactcccacttctataccttgatttcgcatagaacctgcatttgcaaccatattggagaacaaataaggaggagaaggtacatcgtaatcccaaagcaaatcttctgttttacgattataatagtcgatgttacctgtaatgcgatcatccaggaatccaaaatcaaaaccgacgttgatttctttcttcttttcccatcttaaatccgggtttgcattcgaatcaggtcgaatagttttgatccattcattattgtaatagacataagttccaaaattcagggtgtttaatgacatatacggatcagtaggaacagttcctgtaacaccgtatccggcgcgtagtttcaatatagacagtgcttccacatcatccagaaaactttcacctttgatattccatgctgctgaaacagaggggaagttaccccatttatgatcggctccgaatttggttgaaccctcatgacgtatacttgcagcaaacatgtatttacctttatagctataattcaaacgaccgaaataaccgatcagtctactttcatttgcttctgaaaattcggttcctcgtccatcttttaaagcctgtcctgctcccatattattgtatgtatagtcatcagagggaaagttgaaattctgcatataaaaattctgataattcgttttctgccagctatatcctcccagaagtgtaaatgaatgatcttcaaataatgtttttctccattgaacggttaattcggaaagatcctcattcttacgcgtggaaccacgtgaagcatatccgtttttgccgtctctccaggatgatttatgctcttgtgattcgtaatatcctctgacctgattgtaggtattggaagagaacagatatttaatatccagcccttcgattggagtataagtcacattggcgaacatacgtaaattcgtcgcctggttttctccttctacttcattcagtaatgatactgggttataatattcatttttcgaactttcagaataatttccatctttatcatataccggagttgtcggattataaattaacgcatttctatacacttcactattgtaaccgcctccatctgatccggagaaataagtttgtttatagccacttaagctggcgttcaatttcaatttgttattgaacatacggtgtgtaatctcgatacgcgggtagaacatttcgttattagttcgtttgattagcccgttcaaacctctgtattcaaaacttgcaacataattggttgttctacttccaccacgcatgctgatattataaatttgtgtgaacggagtacgagtgacttcatccagccaatcggtagatgagccgtcatcctgacctcccggccatccttcctgaacacgctgacgatattcgtctgctttcataaatgggagggtcttagtgatctgctgggtagaaacataagcattaacatctacttccgtaggcatttccccgttagcgtttttggttgttatcaggataacaccattagtaccacgggtaccataaattgcagcggcagagccatctttcaatacgtctatctgttcaatatcatcaggtgaaacagagtttagatcaccggggattccatcgataagaactagcggactggcactggcttttagtgtggtgataccacgtaatgagatctgtgcggtagaagttgggtttgcatccggagtaataatactcagacccggaacctggcctttaatcagctgggcagcgtctgttgttggggatttaacgaagttttcagacttgattgttgaaatagaactggctacttcgccttttttctgtgtgccgtatccaacaacaacaacttcttcgatactttgcgtatcttccagtaatttcacatctgccgttttattactattgacagctaattctttcgttaaataaccgatgtatgaaatttggaggactgctccctggggaacttccaatgtatattggccattgaaatccgttacagttccgttggtagtaccttttacgactacattggcaccgatgatcggctctccgttattatctgtaaccgtaccggttatttttctggtttgttgattgataagagcggatttgtctgtactgttttttttcaataataaaatatacttgttatcgaattcgtaagtgatatccgtattcttaaaagcatcatccagataagagattattttaccggtttttttatgtacggtaatagcacgttcggtatcgacttcccggtttctgaatacaaccagataatctgtttgcttttctatctggctgataagctgaccaatggatagtacctctgtatcaaggcttataatggtgttctgtgcttctgagttgacagccaccatttgaaaaacacaggcgaaaattataaacagtgatattttcatgattctgaaatattctttaatgtgtttatgatttacagtaaagagtggtaacaaagcttttcttttcatatctttgttgaatattaggtaaatattaaaattaactacttgatgtttacttgatttcttaacggcggatgttacagcatctgccgttattttcttacatggattttatcataggcattactatttagaggttatacattttatttacttaaagtgataatattgttttcttcatttttctcgatattgaatttgtgtatcctttggatcatacggaggatttcatcaataccgtcccgttgacggaatttaccggtatattcccatttgaatatggaagggtcttttacttctatttttacatcatagtagagttccagttttttaagaatgtcaataagaagttcattctcaaaactgtaaatcccatctctccataaaaagtgatcgtaatgcggaattgaaccgattttcatggttccgttttttattatcacctgttcattcggttttagaatgacaccttttttatctggctgtgaaaaatagacatgtaaagagccttctatcaggcttgtctgaatctctttctctccgggatagctatgtacattgaatttagtacccaatactttcatgtctataccccgtgaggagacgataaagggttttcttgtatttttggcaacatcgaaaaatgcttctccttcaacgaatacccgcctctctttatctgagaaaactgccggataaataaatgtagtctgtgaatttaaccacacatctgttccgtcttgcaatgttagtttgacccgctggcccgcaggtacataaagcgtgttgtctgcaattactggatgcatggttgaatgatgattggcggttacccaataggttgataggatcaataacattgcgatggcggcgcaacttgctgcatgaaataacatccgccgaattttctttgttctgatttttgcattaaaacgaatgtatccatcctgattcgcttttttatcatcagcctcgggggtaagagataataaagcatacatatttttactttcgataaattgtttcttcaatttatcgtcggattcaacttgtctcagcaatttcaatctttcagctgcatcaagttctccctggaaatatttttttatttgttcgtccatacgatcggtttgttataatgtaaacacctatatggaaaaaatccgctaaaggacgaactctattttttaaagatagaagaagaatataaataaaaaaaggtgttcttttaattctgttcttagttttttatatgctatacctatctgagtttcaatggtattaattgaaatgttcagttctgtggctatttgtttctgctttttcccctcgatcttgctcataacgaatatttccctgcatttgggagacagagtatcaagcgcacgtgctattattttctcgatatcctgatgggagaaaagactttgatcgaatgcgtctaatgagttcaggttcattcgcagagtgataagatattcttcctgtatcaggttggctgtttcttgtacaattgttttgtggcgtaaatggtttaagcatctgttcttgactgtagtgaatagatatgcaactaggtttatgtgcatagagagcatttctttcttttcccaaagttcagtgaaaacatcctgaacgatattttctgcatcttcttctcgtataacatactccaaggcaaagtacttcatttttgagaagtaagaaagataaatatcttcaaatttgatattttctttttgatcagttaatgcttctgttgccataggttaactttgttctagatgaactcaattttaagcgatacggcattctattgattgtctgttatataggaactttagtagaattattctactatgtattcatattttttctattatcggatttagtgcacaatattaaccagttatactataaatagattatatttgcattgaatataacacaatagttcatctaggactatgtcatttatttcttttgattttatgactggcttttagtatcgaaagttatttatggatgtgtcaaaatgttattttaactgattcatggagggagtgtatttactcggggggagtggttgatgtttattttcgattctcgggatgttttgtattgtgaaatagaaaacataatgcttgataatgaaacaaaaagaagatatatgtttgtttatagtatccatttgctttttatgaattggtgattaaagtatttttgttatttcatttttgaaatcgtttacaaccattctggataaatattctgccgtaaaacatatgaaatgtgttaaaaatattatgtgaatatatataatataactatatttgacataatttgtgctttaaatgaaatgcctgtccatttaaaatgagaaaaatttcgttttaaacgaattgtaatttcgtttaaaacaagatataaaaatggtttataagacaattgtgttaataattgtaatagggaatcttctggaataacaattgggaaagatttataagttatttgattggtctgttttgagatgtaaagtcatgtaaaatgagtattgggtatcattttgtcaaattaaattgagggaatgcaacaactatatgtacgggggcatgtctgggaagttatgcccccttatatacatacagatgcagtagggtatttactggtgtattttatcgataatagtcattcgctcgttgagcgttgtttgtttattattatcccagtacttacaatcgagttcgaagaaggtggaagtaaagggttttgtcagttctgttttgataataactatttcaaacagattgctgatgctatccaaacgggctattaggtcgtcatgtctgatacttattatttcagttgtcggaaggacatttcccatctctgttttcagattatttatccccggacaaaaatattcttccaggaaagatagttcttcgtcctgatagatatgggcatacacatgagaagagttatccagcatgtttttgactgtgcccagcacttccgtataaggctcgctggcgtataaggtcgtgataccttccttagcctgcaatgggtatgccatatccgtgatgactatccagttgcggtggcctaatagggggagcttttcttgcaggacagtttgccagttgtcagaaccggaagtctgttttgtttctatcggatctttctgaaagcaactgcttagaaataagttagcaaacaaacagtatagtataatcagtttattcataaccctacagttttattgtttgtttatttccttctttcagatcgaaatgttttaatttcatctcttttttattgccgatggtaagcgattccaattggagtgagtcgttgatgacttcgatggttacatcattatcggtgacttggatagttccccatgcatagccgttactccagaaatagttgccgggacggtctgtaattttcatgcttttatcgacacccgagtattggaaatcgcttaaagcgatgatagcggaccagcttgccatcgaccgggcataatgatgtccgcattccggttcgctgaaaggattccgtttggctccgtcgtgacggtcgcgtacggattggatacaggtgagggcttctttttccataccttcgtagatcatacctacagccgcacagtattcgaatccggtcataacttcggcaaaataggggaatggaacttccaggcgacctttaggccaggaggccataagtagtccagattcattgcccattacataagaacgcatattattgaaatggcggctgaagtccgtgacataattgtatttcatgatgctgttcatacttgtccggatatgttctttgttacccaaataacctaatccacataaatgggacatatattggccgaccaactggtctaccaggcagccgggacctaattggaaggcggggattttgacattcgggtcattcatatccaagtattcgaaagttttcggatcagtgattttatgttcataatattcaccgttgaacaggtttttgtccatccagctgcttcctttttcgaacagagtatgacatttctttgcaaaatctttgtctttcatggctgtagccatcttttccgcagcctttaatgctcccatataccagaagcccatttgagggttcggaccataatagtctacgtccatggtattatgctgggaaccttccatgacaccatcctgattgccgtcccatcctttttccgtccaagcgtaggagaggactttttttacctgtttccagttgtttctcaggaaatcagtatctccggaaaattgccattcgcggtatattttcatgatacaacccatttgtccgtcagctgctgcactgttgcttttgtttgcttccgagagtgggagtgaggctctgaagttcatcaaaccgttttctttggtggcataattgaattctacgtcacgcatggtttttgccagttccccgaaaagataaggagttgccacttcgtagttccatacatgagtacatgaaccggcacatgagccgaaacggtccatgacaccttcccaacccatcatatgcccgctaggcaaacgaaatacggtctgtgaacgtaaagtggcaaggttaaacagggcagcttcttttacaacatccggataagaagtattgagcaatgcgtttacgaaagataatgtcttcttttccagtacgggtatttgtgggatgatcatttctgctgctttccaggcatccggatactggttgctataatagttgccgactacggtagaagaccaggcttttcgattcgggaaattccaggtgatatagaatgtaaatgtttctgtgctttgaggagctaccattttttttacggatagggaagccatcgggtcttcgtcttcctgtttgttccgttccgtcaatatgccgtctgcactgaaatcatcccagaagtttagtatgccgttgttccagctgtcggatttggatgaggtacgataggtaaccttcccggttgcctgagtcgtaaaggcgacagtcccccatgccgggtcgtttttgtctacaccgtccgagtaaaggtagatcccctttattccgttactttcgatgtattcgtttttgttgtcttttactccggtgggaatgtaatctcctttccagtctgtacggaattggcttccgtctttaccgatgaaattacgcatagaaccacaaatggcaacgtccatcggttggttggtcgtgttggtcacctcataagagaggacagcgacaggcaatccactggcatcggcatcgcccggaatgaatgggttaaaaccttttattttgacttttacgggtaaatctttgtctgataaagagacttgtccgaaaggataggctgcgtcgaacgaggcttcggcaaaacgcggaagaccgtgatgattgacagggcgtccttcataatggagatattcctgtggatataaagggccggccagtagggttgtggtagcttcccggttttgcggtttggcatagattgcaaaaaagggagcattgttaccggttgttaccgtactgtatttctttgccggaatattcatgatttcccagtcccggagttctccgcgaccacccaatgatacggttcctgtcccgatgccgcctaacggcaatgctatctggtaaagatgttcctgatcgtatttctttaataccggccattgttgcggcttccattcttgggcttggagtgctataataccggaaagtattgttccggccacgattaaatatagtttattcatgtgtaaaatatagtttatttgaaagaccggctctataaccggtctttctgttttaattagattaccaattcgggttttgtcctaaattgggattattgtctcgtactgattgcggaacaggccacaaataatgtttcgtaggatcaaaggtacggttttgtcctaagaattgttttaccgtatagtctccgataggtgcattttcatcttcattaatgccatatcccggttcgttcaataccttttcagctattttccaacgcaggatatcgaaatagcgtttatgttcggtaacgaattcatgccgtctttcttcccgtatcttttcacgcatagcttcctgattgccgactaactgatctacgcccggcagttcggcacgttcgcgcacctggttgactgcccatgctatttgtgaattgttcggatcatattcattgagtgcttctgcataaatcaggagaacttccgcatacctgtacaggctgaaattagtccatgaggcatccggtttaatcaattcctgatcattatattttaaatacatataaccagtgataccaccaccttcatgattgatcctttcgtctttgttataagccggatgcggcatgtaaggttcgtgagaaccatttggacgcaagcattcataaccgggcaagaagaaagtcttttttaaacgggcatctctgttttcccatgggttgttcttgtcgtaagaatctgattcataaatactctttccgtccttcatttcgtatgaatctactaactgacgagtgggacagaagctggcccatccctgtccggtgatacctgttccggccggagaagctaaaataggcaacatgtgagttatttcgttttctttatactgatacgccagtataacctctttattgttgttgttggcttcagctttgaagatatatgcgaaatcgtcttccaggccgtacaagttcatgtctataacctgcttggctgtgttggctgcttctttccataaatcggtcgcttcttgtccgttgtgaaatttggcatagctagctatatccaaatacatatctgcttttaatgtgagggcagctcccttggtgatgcgaccgatgttgtcgcccgaataagtttccggcagatatttgattgctttgttgatattttccagtgcgtaatccaaaacttcctgcttaggtgaacgtggtagtgctgcttcttccaggtcgatcggtttttccttgattaaaggtatgtcaccgaaatgacgtgtcatgcggtagtagcgcagagccaggataaagcgggcttctccttcatactgttgctttttggtttcatctatattcataccttccaggcgatccagaaaatacaatattctgcggatatgatcgtatttccattcttctttcagataaccggtaccggcattgtgggatccttggcaaatatatcctaaaccactttctccccaagcatttgtcatcaatgagttgtcgctttggcaatctctccagaaatcgcgtgagtttggcaataacggatataaagcgtttactccggccaaagcatctgcttctgtttgccagaacgtattttcggatgcctgtgaaagaggaacacgatccagaaaatcagaacaactactcaatgtgagtgctgaaactaataaaaatgctaaactatattttttcatgattcttaaaattgaagattaaaaccgaatgagaatgttcttgccagcggataccaaccgccttccgggtcgaaaccgtcataaccggtgatggttgccagattctgtccggaaagatacaatctcaaatattgaatattgacacgttccaatgcacttttgggaacagtataaccgatctgtatattttgtattttcagataatcggctgtacgcaaccagaaactgttgtatctggaatcgtagtcattggctgtgttcgataaagtcagacgcgggtaggaagcatccctgtttgtttcactccatgcatccaggtgcataggacgtgcgttgtctgtcaggtagaacgcccatccttcatagccttgaagatattttttgaagttcaattttccatacatattcatagagaagtcgaaatctttatagccgaacgaaagattcataccgaagtttacaggaatcttacggtttagtacgacacggtctttttcgtcgattacattgtcattgttttgatctttgaacttgatgttaccgggtaacacatttccttgatcgggtgagccggcaatctcttcttcgctttgaaacagaccgatagcctcgtatccgtatggcaactgatagcggtcgtttagataagttactttgttgttgtcttcaatccatctttccgagtcacccatttccagcactttgtttttagaataactgaggtttacatcgacaccccaacggaaatcacccttcgaatcctgataactggtcaggatatccataccctggttcttcatcttcaacagatttgaataaggggcattcagaccgaactcgcttggtacaggtggacgatatagaatattgtctctcaggttgataaaatagtcggcagacaatttaatacgctgatccaatactccgaaatctaaaccaaagtttgtatatttagactcttcccaagtgatgttggggtttacggctatattattataggcaccacctaccagtttgtcgttgaaagcgtagattttgggatcgtaagataaaatctgtgcagtcggataataaccaaccttttccgcatctcccaatataccccaggaagctctcaccttcaactcagacaaccaattgcttgcaggcatcataaaagcctcacgatgtatattccagcctccggaaaaagaagggaatacaccccagcggtgtcctttggcgaaacgagaggagccgtcagcacgcaaactggcttcaaacagatatttaccctgatagtcgtaatttagacgaccgaaccaggattgtacggctacatcattactatattcattgccattgccgtcggcactgccgttctgcttgttgtcgctaccggtgttcagtacgtctatgccgtcaaacggcagtttgtcacgggaagcccagaaaccatcagacttgtaatattcctgtgaataaccggccaatactttaaaattatgatcagctgcgattttgaaagaatagtcgcttgtaaactgtaattgcgtacggaaattgtaagtatttgtttccttcaaagaagaaacctgattttctgtttttgcaatattcccatcattgtcatacagataataagtattcttacggtccttgtatgtcgtgttatgggagtaagttgcaatattacctttgatattccagtcttttaacggagaatagctaacatcgaaaatagccatcatctctttatgtctttctttggaatatcctgattcattgacaccggcaatgggattaccacccatggcaccgcctgtggcgtaagaaccgtctgtattatagataggagtaaccggagagatacgtgctgcttgtgtctgccagattgttgttccgccattcggattcttgatattggtttgtgtatattgcagactggcacgagcttccaggttctttaaaatctgaaaacgcatatccggtttgaatatcaatcggttataattgttgttcggtaagttgccgtcttgatagtcattagagatggagaaacggtaagagattgatttttcttttccggatagtgcaacatgggtattgttgataacggtattcttcttgtaaatttctttataccatttgttatctacatatttgcccgcatgtaaatcctggataccttgttcgccgtagactgcctgctttccgtcgtttatcatggcttggtcatacaagcgcataaaatcttcagcacctacgaagtcgagtttaaactgtggattctgtataccgatattactcgaaaattcaacggttggacgttctgtcgctttcgctcccttggttgttaccaaaataacaccgttggcagcacgtgaaccgtagatagctgccgaagcggcatccttcaagatggatacactttctatatcgttaggatttaacgtataaatattaccgggtataccatcgataagcaccagtacaccggagctatctccgatagtagatattccacgaatattgatacttgcccctgaaccggctgcaccacttcctttagtgactaccatacccggtacagatccggccagcaactcctgtacattcgttacaggacgggattttaaaacctcgtctgcttttacagttccgatcgatccggtcaggtttactttcttttgtgtaccaaatccgacaacgacaacttcatcgatagcctgtgtatcttcttttagaatgactttcaggcttgtttgttttcctgctctgatttcttgcggagtataaccgatatatgaaatgacaataatgtcattatccgatatatttgccaggctgaaatttccatcgacgtcagtaatcgttccattggtagtacccttgacagatacatttgcaccgatgatagcttcgcccttttcatcagtgattatgccattagttgtccgtgctttttgctgcgtggatagagtcttatttcttgtctctttttttatcagcatgatattggaaccttccatggcataaataacatctgtttgatcgaatgctttattcaatacttctgctactgtttgattggtcgcctgaatagttactttgcgattcaggtttacttcattttcattgtaaacaaacaggtaatctgtctgtttttcaatttctagcataagatcctgtgtcgaaatgttatttgcaacaatggaaacttttgctgtttgtgaagttgcttccgtagcaaatatgccggatgcaaaaataaaaatagacacaaaggctaatttcataatgcgcaatatatgtttataatgtggtttaaatgggataaaagaatccctatacaaaatatttttcatacttttgtagactgtgtttagttaatacttagatatttaagtgatgaagtcgggtattgacttactttaaaccgataggtgttggagcacttatcggtttttttgttcattcatgtcttttatgtcataggctaactgtttttatgattaatttatttgatagtaattagattccgatcattatctttttcataactaaatatgttattgagttgaagcacctttaatacatgctctactccatctttagttcggaattttcctgaataacggttttttaatagtgacttgttttgaacatcgatttttacatcgtaatataattgaagtttctctatcattttatctaccggttcatcatagaaacagattaatccttccttccataaaaaataattctcgtgttctatcgtatctttttttagtatgccattttcttcgtaggtacgcatatgcggttttaaactgacttttacgttttttgtcggagaaaatacttcgacagctccttttagcaaagatgtttcgaaaaccgaagaagctgagtaagcagttacattgaattctgtacctaataccttaatattatagtgttcagtatttactataaaaggtttgtccggattttttgttacatcaaaatagccttccccatctaaaatgacacgacggttattagctgtgaatttattggggaatgtaaaagttgtttttgcattcagccagacttttgtaccatccgtcagggttaactctgccctttgtccgggtgggacaaatatggtttgcatacttaccggatctacatcttccttatttataaagaatgaatacaaaacagaaaaagtaatgataaagattgctgctattttagagaattcgattgcaatggatcgtaatgtccgtcgtttatttgccagatagatatgtcatataatttacgctgagcaagaaactctctcatattttccttgtcagcatccagccagcggacaatgtcttccttttcttcttgtgttgcttcgcctgctatatatttatgtagtatttcctgattcatatttttctttttatgggtatgttttatgccccgttattataaaaacgatttacaaagtgataaccctagtgggaaatgaaaaattattggaaaaagaagaagaaatagaagagaggaagataatctttcagattctcccgtaaaggttttaaggctttggtgatatgatattcgactcctttaactgtgagtttaagctcttcggcaatctctttatttgttttgttctcgaagcggctcatttcgaatacacggcgggtttgctccggtaaaagagctaaagtagcggtgactatctgctgtacttcggtagagaatatgtcttccggattacatgcttccagggtggaaatgcgaatatccagttccctttgcttcatatctgtcaatgaatggattgcttccgtcttgattgcttcatgtttcaggtggtcgagtgatttgttttttaatgtcgtcagtagtaaggcttcgatatgttcaatctccttttctttcagtatttcccataattttatcaagacatccgatacaatgtcttcggcaatgcattcgtcgtgaacataagatttggtgaacagaaaagattttctgtagtatttagtatataaagtattgaagttatgtatttcagtcccgatcattttctctctttgttttcacaatagtcgttggggacaaatgtagggaaaataaatataaattaaatcccatcggtaaaatattgataggtgagatacctgaaggaaagaaaatagtagcataatgaaaccggccccggtaaggttcgggtcaaataaaagagtgttgtcggcgataagttgagagggaatatgcgccctgctgagtacagggcacggtattcggggccggcttcattactactattttagtattaattaaatgtgtacgtaactctcacgagttagttcgttaatccatttcaaatatagaacctcattcggaggaagttttgagacccctttaccggatgtcgtggtaagagcgggagcattgcttcctccttttccccgtaattgtgcttcttcttgcgatgccggaccagctacactatcagactttcgtctgtacatccgggcagccagttcgtcggcactgcaacaaagtacatttacgcagagattctaaaccataaccaaaacataaaataaaacttacataatgctgcttgtagcatctttaccattaccctgtatccagtcggtaacggatacctctttcaatgtaagagcctctccgctgagagttaatttgtagaggtatttatgtcctttttcccaaactgtttgagcgggaattttatatttatatgaacttccatttattgtaaagagggcttcaatgtctccttcagctatgggtctcgatgtcgggaatagcctgatatgctgcggatcacaaaactctttcgtcagtgtaacagcttcttcgaggtttaaccgggtggaggtcttgcaacctgctgttccggtaatttctccggttctgatatccatcatacccctacaaataagtgtgcttcctccggccttgtttccaacctggatggcacttagctgataatctttgttttctccttcctgcaagttgatttgaaaggagataagagataaagcatggttcatattcaggatcactacaggtgaaatactgttcactattttctgaccaacagcgtgtgtgccatacatatagtcgggagtttgagttgcatccgatgataactttacaggaatactggctgcactcagtctcatttgcgactgatacggataataggcatacacggtggccgggtcgaagttaagggagacttccggcgtttgttgccaggagattttattactaattaaacttgctttcgcttttacatttatataatcactatcctcatcatataggccaccgtcattttcgcgggtgatcagtagtcctatttccgatccgtctttgaattcttgcacgaaattcgcagattttgtagttaaaatacgtgtaataattcttaatggtttttcttttgcgctaatactctcaatggctacgatattgccttcgttagagcaacctgccaaacaggaaatcagtgtaataaatagtaataaatttctcatacttttatgttatttttgtatcaaatttcatattgcaaatatccggcggtttgagcaaaaagagggatcatacggtataaaaccacgatgaaatcgtataaaaacgcatgatgcaaataatctaaagacgtcaaattgtctaaatatgatgcaaatcaactatttgagagtgcaatttgtttatagataaacgaggcgataggagtatgttagacaaaatacagtttttattaagtatgcagataatcggcctatgcattttaggcggtattatgatgttattaaggtcattcggtaaccgggcacgacatattttaggctggagtatgattatgtgggccttgatggctgtgatccggatttctattaattcttatgtcgatgacgtgaaggtaacatttcatcccgacgtactaattgcaagttgttttgtgactgcttgccttgactgttatgtgattgaaaagctacgtcccggttttcttactataaagcggtttgcagtttttctttcgcctgttgtgataggcgatcttatcttatttatcgtttgtcaggcggagaaattcatatattttattcgataaaagacgtgtttacgcactttaatatggatgtattcctgcgtttattggtactggttcttacttttttttatatgattttaccgatatatcttgtcgtaaagtacgccgatgagtattccgcttatctgagcgagaatgtttcggatcctgaaaattatgacttgagatggttgaagcggataatgatcgtgttatctattctctatttcctttatgtggttttgttgctgaccgacagaacgatcctgtatgtcgttattaaggctattatgctggttgtatggttttatttcttctataaagcattattccttaagaatatccggattgaacactcctttaaaaacggatgggatcttccgttgagtgtggatgacgaggaagacgacgatgacgaggagcagcgaggggctcttttcaaacgctatgctgaagaggtgaatacctggtttgaaagggaaaaaccttacctgaatgatgatttgcggcttactgatttacaacgcgtgttccctatcagccgttcttatctctcacaactattcaataaagagctgggaatgtctttttccgattatgtgaaccagttccgtgtggaagagagcaaacgcttgatggatgccgaacctttggccagtatccaggatattgccgaacgttccggttttcattccatcagtacgttccgcagggcatttaccaaacataccggcattattccttccgaatataagagaggataaccctgtcttgtatgatttgataagattacttacttttacatcctgttgaagaaaataattcttgtcatgaataacactactgctgaacgtccgcatatcgtatggctggacgtacttcgtttcgttgctatcctgatggtcattgcctgtcattgtaccgacccgttcaatgcctctccggagtcgcgtgccaatcctgaaattaatttctggggatctgcctatggatctatgctaagggcctgtgttcctttgtttgtaatgatgacaggctttttattgttgccggtcaaacaggagacatctcttttttataagaaacgtattccgcgtgtattctttcctttcctgatatggtctgtattgtttaatctggctccctggtttatccagtgggtaggaggaagtcctgaactggtgaccgatttcttcccatgggcgcccgatccttcagcttctttggttgacgggctgaaagatattgccatgattccgatcacatttaccgtatacgcaacgccgatgtggtatatttatgcactgatcgggttgtacttatatatgcctgtattctcggcctgggtggagaaagcgtccgataaggggaaacgttggtttctgattgcctggagtgtctccctgtttattccttacttggtggaatttgtttcgcggtatgtgttcggaacctgctcatggaatgcgtatggactgttctactattttgccggtttcaacggttatctgttgcttggccattatctgggtaaagggaatgattggtcagtcggtaagaccctggcgatatctgttcctttgtttctgattggttacctgatcacttttgcaggctttcgttatatgacttccgatcctaatgtaagtgaagaggggatggaactcttctttacttattgttctccgaatgcgatgctgatgacggctgctattttcctgctggttcagaaagttcgtattacgtcacctttggtttgtcgtgctttggctaatctgacaaaagtaggattcggggtgtattgtgtgcattatttcttcgtagggccttcttatctgctgactctctggctgggtgttcctgtgcctgccattgtacctgtttcggctgtatttacgttggctgcatcatgggctttcacctatttggtaagtagattgccttattcgaaatacattataggataagggatttcgggaaacgggaggtctgtttgtgcaaatgatgttaaaaacgggtaatgctggtataacgtatgcgtattaccactacttttgtgttgtaaaacatatttatatgacatgttttatgatgagatcgttttaaataaatagaaagcgctatgaaaaaagtagttagtaaatgcgtcaaatatctggaaattctgggtgaatatgcgatgcagaagtatggaataagataaaataaatcttttcagcgttaggggatgtccgtgagggtatcccttttttagtttatggctggtaataaccgtaaggtataagctcttctatctgtttgatctctttgaggtaacattggtcaagcagtgtcaagcggttggctattttgtgcacttcccggaagttatggtctgtcaggatgataccgtgttctttggcgctttcggtcatcagttcccgtatctgttcggctacgacaggggagacgccgctgaaaggttcgtccagcaggatataaggcgcccggctgaaaagggtggctttgatttccaggtaacgttgttctccggtcgatatttcacagatgcgagaggtacggaggcggattaatattttgtcggctaggaagcgttttctgtcttccggagcgatgcatagatctacgacttgcgatattttcagatgggagggtagcaagtgatgttgtggcagataggcaatcaaaccggagcggaaggcagggccgttcatcactttcccgtcgatacggatgaaactacgatcgcctttcaaggttccgaatatgatattcaatagggtggacttacctgttccgtttcgtccgaagagggctataatatctcccttacaacatttgaggtaaatatctgtcagtatcggacggtcaccgaaggctttcattacgctgtctatttcaaggcctgtatgcatagttgtatgatttgattcaacagattacagccgatgaacataacgatgaaggtaacgccccagagttgatacttgccgattccctggttgtagtagaagaaatattcttctttgcgggtcaattctttataaataaggtcgaagccgagtccgactgtgggaatgaaacggagccagagtttaaggtattcggtaatcccatcgtgataaatgagtattcccaaaaatgcaaaaagaaaactaatcaggacactgaattttaatgtgctgaagaagaatatccgatagaaccggtattgtgttttccatctttgcaggctattcataaacagtcggtttacgagagtaattgattttttgctaagatattcaattacttgggaatgagggaaggattctttttaataaagtataaaaaggaacagtaaagataggtatggaaaaggtggataattgtaatggagctgggaaaatcccagctccattagagtgtttatttcttgaaggcagataacataggacggccaatccatacctgtggttgtttcagattaaagatataagcaatagttgatgcaatatcaaattgcatcatactgtcagaaatctcatatcctttcttgatatttttaccggaaataatgaaggctgtttccatttcctgcatggtcttgcctccgtgtcctttattaatgcctccatgatcagctgtgacaataaagactgtttcgtcaagtattccggcttcttttacggcattaacgatttctcctacataattatctagttcttttagtaccgtgtagtattccggagtatcatgacctgctgcatgtccgacgtgatccggattgtcgatgatgacagctaacagattaggatgggctttctttatataatcggctgcatattgtgctgttgctgcggggttactttctgcttcggaaacatgtttgtcgtaattgagagcgaaggtatctacaagacagcgaattgtttcccattcatatatacaacctatttctgctttggggtcggactcatgtaacaggctaaatactgtagggaatattccgtttttattaatttcccgtgaagaaagttcaggtgttttggaataccattcagtatatccgtgaagttcaggtccggctcccataaacatggaagcccagtttacagcacttgaagatggtaacaccgaccgcttcttcaaagtatatgaaccatccttcataagtttttttacattgggcatttctgcttttaaaacactataagctccccagccatccaggccaattagtataacatgtttggcatttcgggaagatgcatatatattgtttgtactgagggcaaagaaaatgcccagtagaattaataaaatattctttttcataactattgattgtttatttaagtaagatccacattagtttgttgttgtcatccagtccgtcatattgacgggcaacggccttttctacgctttctctgttgaaatcatattcccaggttgaatacatccatcgcacaggaattttgtccttgactgtgtttcggttagtctctggattaacaggaagctccggatatccggtgcgtctgtattcaaaataggcatcaaaaggatattgcatatagtaagccagatatttttgtccaatgatttgtttcagcttatgatcgaaattaccagataaggtaatacggtcactattcaaatattctgtgatataattgtcggtaatcttcataccatgatgatatttgacgtcgtcaggagtattatctgcaacaaatttcattgctgctttaataccgttgttgtagtatgaattgatatctccgcttatccatcctcgcaatactccttcagcgagaataaaacattgttcggcataacctatgcgcacataaggttcacaggagatgacatctgtatatctgaggttcatagtacagcattttccatctgcattcagagattgaagatcagagaagtcaccagcaggatccaatcctttataagcattcacatcgttcacctgtaatccttgactaataaaagcttttgcaggttcagcaaaatagaacaggcgataatcgttgtaagctttaagtgtatcgacaattacacttgatatagttgaatacatataatgctttgatacggaagtgttgaaaggataggtttgccctgccttattagagaataccagttgaaaattatcttcatttgattccatgagatttccttccgctacaatttgtgcaaaccgttcttttacttttaatacaggatgattctctttcatggacagatacaataatactttcaagcggaaagcatctactgtcttttgccattttgaaatattaccttggaagatcggatcgccttcgaaatcttgtgcttcattgaaaaaacgggcggactcatcgagatcgttcataatagcgatcattacatcttcctgtggatcatattggggtttgacatttccctcctcaccttgtaaggcttcgctgtaaggaatatctcccagcttcatagatgtatagaacagttggtatgttttgatgaaaagggccaaagcctgataggcagctttatcttcttccgaggccaattctaccatttttacagtattcatcaatgtcttatatcctccaaggccggctcttcccaaaacattgtaattgtagtcatggagagattctaaccataccatttgtttagccaggcaattgtctgaaataaacccggatccagtacctcctgttgctgtcagatccagtaggagcggggttgccagtaaagatgacgatactgtggttgccgcattagggtttgtatttatatcatcatatgcggaacatccatatcctgcaatgaagaggatcgatagaaaaatatattttagtgttttcatatattatttgattaaaaattgattttcaaattacatccgagcatacgcaaagaaggagaatttaagttttcagacgctttatcaggatctgagaatttgaattcttttgtccaaataaacaaattctgtccgatgaaggctacggaggctccttgcaaaccgattttcttacagaatgtaccggggactgcataggttagcgatagttctctcagtttgatgaatgtctggtctaatatatgttgatgcttggcatcccatacatttcctgctccattatataacttcatatatccttcataggatacagccttatcatttggagcaaaaactctgtcatctctgaggatgtttccattagagtctctgtctacacttcctgaaacaaccattacgccctgtcctacatagcttttattgccgttaacaacttcgtcgtatctccatgggctatcactgtcaatatgtgctcctgtcatccaaagcgcttgatcgataaccgaatgagctactcctccgacacgaccgtcaattgtaaaacctagcgtaaagtttttgtatttgagagtattgttaaaaccgaatacccaatccggatattcatttccggcaacactttggtatttactttgaatagggtagcctccttcatgtattatattcccttgtgggtcacgttcccagtcatagtatcctagccagtcccaacgttcgcctgcttttacccattctttttgtgtggaataaaccggatccactttggagtaataataacgatcgagtgaccagttgaaagtggcattccattcccagtcttttttctttaaaagagttccacccagagtgacttctacaccttttctaagctgttcttcgtcaatattaatcaatgtatattcgaaaccggatgcatcactgatggatgcgtcacgggttaaattataatatagtttattataataagtgatatccagttgtaatctgttattcaggaagtgaaaagcagttcctatttcgtatgaacgggttgagctcggtttaatgatagcacttctcattttggtcggataagtagctccattcattccatcccacatgtttgttgtaatagtataacttttattggtatcgtagatattcaaatccttcttggtctgtgtccaggaacctctgattttccagaaatcaatccatgacggcatgggaattaattcggaggctacgatactggctgatactgaaggataaaagtaagaacgtgtttctgaaggaagggtcgacgaccagtcatttcttccggtgacatccagaaagaaagtgcttttccatgctacggaagctttcccgtaaagactatttacctgtttctttttaatagagctccccagttgtgcaggatcgttggaagcattcaaagaatagtaaccaggaattgaaatgccgtttttagtctttcctgaaagccagtcgtcttggtagaagtaaatggtacctccaacaaaagcgtctacaaagaagtctccaaatttatgatcggcagttaacataaagtcattattgatactatatccgccacttcttttttcttcgtaatatccttttttattccatcctccgtaagcaccaatagagtttctccatttttcacgttcactataagtgtcgacacctgatcttaatgaggcttttaaccagggggtaaattcatagctggcagtgaggaagccatttactatatcatagtcgctggaatgaacaatttcattagcaatgaaatatggattgtcgtaccatactttattgggccagttttgttcttcattttcttttttccagtaattcttataatctctgatatccaggtctgtcccagtccagactaacatgctatatatatatcctccggttccatatcctgtaccggtattattaggataaaaacgtttattataggttagaccgccttcaaatgtgaaatttttgtatttcatatcaccggcaacagtataattaatcttattcaatttgttatttggatattggcctttattatagatatgagtcaaggaagtacgaaaactaccgtatttacctttttgtgtaacgctgatattattgtttgtgacaaaactaacttcaagaaagttcttgaagttatttttgcccttggatactaatggcatttcacgccattcatgtgtataaggatcatattgtgttgctgtatggcctatatccattttgtcaccccatacaaagtcttcagagttgtattttccattcatccctgtactgtacgaagtctgtactttaggtaatcgcagaaagcctgattcgaacatagtactactgttaatgctcacgtttagtccatcttccgtacctcttttagttgtcaccatgatagctcctgttcctcctcttgcaccgtataaggcagacgctgtagcacccttcagaacatcaactgattcgatatcgtcggaagctatgtcacgtagggatatattactataaggtacgccgtcaacaaccaatagaggttcttctccacgtaataaaagactgggggcttcattgaactcagtactgttttgtacgttcaatcctgcaattttaccggttaatgcagttcctacatctactgatttaactgccgatactttatctcctccaactttctgtactgcatagcccaatgctttttccgagcgtttgatacctagggccgtaactacaacttcttcaaggtttttagagtcttcttgtaaggtgattactattgtcttctggttgtttacagctatatccttgttctgatagcctatataagaaaagataagatgtgcgtttgctggaacttcaatagaaaaatgaccatcgatatcggtaactgttccagtagaggaacttcccttcaaaagaacgttcgctccgataatagggatatttaactgatcgaccacagttcctgtcaccttgatcattggaacttgaggttccgaggatttggaatatgatataaggcgtttattttttgtagaatgtatggatatgtagttatccaatactttataagtaagtcctttattcattaagactgcatctaagacttcttttaccgtcttattttttgcctctacctttacagactgtgacaggtttatatctgtatctccgtataagaacagataatcggtttgtctttctatttcggagattagttcaccgaacgaaagattacttttggtgatagtgattcgtgcttcctgcgaatgcgtatcgatggcatgaagctggaagaatagtacgaatacaaaaaacacggataatctcataatacgaataatgtgtgttaattcatcttgtttgaatacatagcatagttgcaacaagttttttttcataactttgctgatagtttaaagttgatactgtaatctgtctcgaaatgggttgatagtattgactctttagggtaagtgctgcaatcacttaccctttctggtcctatcatagtaattgttcttttatttcatgggcaattagatttaatgagttaaacatctgtttattaatagatttcgaattcatcatctgttatttttttgaactcaaaatgataaacaccttgtaaagcacttaatattttctctacttcttcactttgtcggaattttcctgatattttgcgggtaagagtaactgttccggtcactttgaattttacgttataccaaagtgacaggcagtcgagtatttctacaaatggttttgatttgaagttatatataccgcttttcaggtaatcccggttatcgaaatcagaactggatttaaccatgatatcattgattaccgatactttttcatttggttttaaacgaatattttcatttttgttattcctgttatatacaagtacggaacctttgaccaggctggtttcgaaacgtggaagttctgtataggagaagacattgaactctgtacctagtacttcgacgttgaattgctgcgtcttaacgataaatgggcgtttgggatcttttgtgactgagaaatagccttctccatctagctcgactgttcggtcattccctcggaattcattgggtattttgattctgctccgggggcttagccatacggatgtgccatctgctaaggtcatatttacacgttgtcctttgggtacgtttatttctgtgtatagatccttttgctgatactggttgtatttttgagatgcaaaccaggaactgattattaataccagtgttatcgctgcatatttcaggagattgatcctgaattgtctgacggtacgtttcccaagtcgtttatcaaattcacggattcctttgagggtcttttcctcatcttctttccgatcagtgagttccgagatggcaagtgcattctttgtgcgtacaaattctttttttgcttccggatcggtttccagaaacaggaagagttctgctttttctgtagcaggcatatcaccggagaagtatctatctaatttattattcatgactaaattgtttgtctcttatagtaaagacaaaagcacgggaagttaccaccaaatgaaaatgaaaaaaattacttttttattcgagtaaaaggtaagagctattctaaagtatgaaaagtaggagaggcaggtaatcttttaattcgatttttaacttgcgtaaggctatagacatttggttttcgacagtattcacagatatatttaatcgttcggctatctctttatattttaatccttccatgcggctgagtataaagatctctttacaacgttccggtagtttgtcgattacttcgttaatcaggttttcaacatctgaaatagtgaggaatgattcgtcaaattgctggagagagtacaggttcatttgcatttccagttcttctaccgtttgtatggagctttttttctcatttacatacaggctgtgcttaaggaaattcaaacatctgtttttgaccagggtaaacagaaaggcatccatgttatcaatcgttttgaatacttccggatgctcccatagataaagaaatatatcttgcacgatattttctgcatcttcttctgcaatgacataagcttgtgaaaagcgtatcattttggtaaaatatgtagagtatatctgcgagaaacatctttgtgtttccagtgagttaatctgttgtatcttgtgatttttcaaatcttcctcctttttctctcaggcaaagataattaatctttctttttacaaataaatattcccccttactttacgaaatctccgggttgtttcgaaagtaagagggaatgaaatacctgaatagactatattgtgatcgttctatattacttcactacgaatgtatctttcaacttgatatcggtagatgaggcacctatccttacttcgaattcacccggttctactgtccattgcatgtgtctgtccagtatctgaagatcttcgggaagaagggtgaaggacactttccgggtttctcccggttggagggagatacgttcgaaaccacgtaatacagactcgtaagcgattacactgctcactttatcgcggatgtataactgcactacttcgtcaccggtgcgtttacctgtgttggtgacatcgaccgtgactgtaacggggctttgcgaatacggcgtttcctgcttgattgcaaggtttgagtaagtaaaggtggtgtagcttaatccatgaccgaacgggtaaagagcgccgtttacacgggtatttccggagccgttagggcctgagaagtattgtccgtcttgtgaacccggtttgaacgggaagttaaactcgatctgtccggtcgttttcgggaaagtaactgacaaacgtccgcccgggttgtaatcaccgaacagggtttgtgcgattgcttctccgcccagttggccggggaaccaagcttcgaggatagaaggaatgttacggtctgcccagttgattgttaatggttggccgttgataaggatgagcacgacaggtttacctgttgcgtgcagagcttccaacagttgttgctggcggccgggaaggtcgaggcctgtacgcgatttactttctcccgtgcaactttcatcttctcccagtacggcgatgattacgtcgcaatccgctgctgctgaagtggcttcggcaattgtctgtctttcttcgtccgtcagcggagtaggaacgatttcgctgtcgggccagttagcatctttgacttcacaccctttggcatagactacttctgtctggttacccagataacttttaataccgtcgtaaaccgtgatattatccaatccctgcgggccgtaacgactgatcatatagttggtttctttggctaacgggcctgcgataagcactttctttgtctggttcttatccagtggaagcagattgttttcatttttcaggagaacgagtgattgctgttgcatattcagtacgaaatcgcggtgtttgtcggcaccgacaatcttatctgccgctttcgggtcttttacatacggcgagtcgaacaggccgagttcaaactttacacgtaatacgtcggctaccatacgatcgactgatttcatggatagtttgccttcttttaccaattgacgtaccggaaggatatagtcggcgggatgggtgaagttggtacggacattcagtccggcttctaccacttggcgcacggcttcttcgtaagagtcggctacgtggtgtttggtttgtacgaattctacggcttcgctatcgcttaccacgtaccctctaaaaccatattcctggcgtaacagttcggtgaggaagtaataactggcggtaacgggtacaccgtcccagtcgttgtaactactcattacacctttgggatgggccttttgtattacttttttgaagggatataggtgaatttcatgcagttcgcggggagcaacatgcgggtcggtacgcacggctgcatcgcgtccacctttcggaatgctatatacggcgaagtgtttcagggtagaagctacgccgttttgctggataccgtttaccatttgtatgccgagctcgccgaccagataagggtcttctccatacgtctcgagtacacgtccccagcgaggatcgcgggcaacgtcgaggatgggggcatatacgttgttatatcctaaggctttggcctcttttcctgcaatatctccggcctgaagtaccagcgaacggttccaggtactaccgatgttgatcggagcgggtagaggagttgctttagtatggttcagtccgtgaataccttcatttgagaagtcgacagggatacccaggcgagtttcttctatgaaccaccgttgtgtcttgttgattgcttcggcatggttgctaaacggatagatcatttccggtgtcctgcggcgagcgcttcctactccatttaattgttcgtcgatattggcaataccgtctttccagatttcgttcttccatccttcggtagggagggagtctttcaagacacgtccgaagccgtaaagggttgccatctgacagcttttttcttccagtgtcatctggttgagtagatcttgtatacgtgcctcgacaggagcggaggggtcctcgtaaacgtcttttacaccgttcttattcaagtctatccacccttttttatagatcgagtctttggcttgcatagtaccgctcccaagacagatcgctactaataatgaatatttgaaattcatgctattataggattaatatggtttgttgtaatataaaaccgtatggccggtaattattagcgcaaaggtaacaattatcaaccatacggtcaatgattagtagctattcagttggatgggactattttacgtcccaccacagacgcgcgtcgattttgttgtttgctgattgagcattatagttttctgtgttcatggatgcttctttcgaaggatacaaaaaacgtaccggagcattttctttgtttagcagagcaccgttttcgcggtcgtcatccaggacaggcaggtctgtacgacggtattctgcccagttttcatatatctggaggaagccgaggtgtaaccatttctgggtagcgatctgctctaatgcttttgatgaattgaacttgaaagttgaagtggctaaccagctacccaacgttccgtcggatacgtctctgttggcgatattcatatcttttcctttctctgcatcgctgttcttataatattcgtaatagttctgaatagataagataacccctttgttatagaactcttcagcatttccgctaaacaaaccacggtgtgcagcttctgccagacagaaataaacttcagcagcagtcataccgatacctaccggcaattgatagtttttacggaaagtaaccgtgttaagacatccgtatatcttgaaaagttcagttccattcggtccgtttaccagagcgattgctttgtcggcagaagaaggataaccgatgatctctttgctatcttcgtaaacatccccttcgtcatctgttgccggctgatagaataccaccaggcgcgggtcggctgcttctttcagcaagttaacagtgaattcgggtgcatacatatagtagctttgtgctttggaatgactttcgttcatagcacgccagataccgtcaggagcagtactctggttgtctaccttaatatatgtgttatcactgttgctggtaatcaactggtctagtgaaagttctgccaatacttgtttggccttgtcaggatcggcatttgagatacgcatggcataacgcaggcgcaatgagttggcaaacttgtaccagccgtcgcagttacctttgtagataatatcctgttgtttaaatatattgctggtagatgctgtcttgaaataagcggcagcagatttcaggtcttccagaatagaataataaatatctttctgtgtatcatatttcggtttgaagatcacgcttccaccatagactacgttacgtgcggtgaaggcctccgtgtaaggcatattgccgaaaaagtcggtggcgatagccgtgttgtatgctttcagaaccttaccagcctcgacaaagatttgatatttggcctgttcgtccggtgacagggtagcatacatcttgtctatctcggtcagagtactcatacgggttacgtaatagttttcccagcgggccttatcgtcctgaatgttctgatacaggttgacacggtcttttcctgcctggcgggcagttgtctggatatagttcccgatcaggcggaagttgtaattatatgtatcggcgtaatcgttttcgattgctttcaacgcacctttggagaaaaggtattcgatctctgccgaggtaaatccatccggattattgtgcttgtcatccagtttgctttcgcaggaagagaaggctacgacggtgcctagaagcaggctatataatatgtgtttcataaaagtttactgttttattatgagtaagttactaggtttagaaactggtgttgatagcaaaaccaaagcttctggccgaggggtaagaagtgtattccacataagggttcgtaccgcctgtacccagtgttgcttccggattcacgttaggaacgttcttatagatgaagaacaggttactaccgattaatgaaacattcaggttctgcagaccgatcttagaaacgatgttgttcggaacgcggtaagataatttcatttcacgcagtttgatataggtgttatcatacaggttgtcttcagaaccgttacggttgtagcgcgagttgtaataatcggctgctgatacaatgatgtcgttcttttctcctttttcgtttacaccatccacaatgataccgtcgtgacgtacacgtccgtcaagtgcatttgccggagctgaggcgctgtggctgtccagaggaattttctggttactgttcttgtcgatataataagccagaccaccgtattcttcatcgcgtccccacaaagattctttacctgcaccagatgctttcaggaagttgttggtgaatgaaagcagtttacctccgaacgaaccgtcgatatgtacgcttaaagaaaagtctctgtaacggaatgtattcgtgaaaccggctgtgaatttcggtgctgcgctacctgcataagtgaattctgattcctgctggtagttaccgttcttatccacaacgattctgccctggtcgtcacgtacccatttacggataaatacactaggtgtagcatatcccggaacagctttgaagatcgctgcactccacgggttactgatctggcggtcttccatgccatcgatcagagaaagcagttcattatgtgtataggcgaagttcagaataccttcccaactgaagttcttggtttcaaccggagttccggtaacctgaagttccacaccacggttgccgatctcaccggcattcattctcatacctgtagcacctgttgaaggagcgaccggaacagtgatgatctggttcttagtcttgtttgtatagaaagcgaagtctaatcctaaacgtccgttaagcacgcggctttccaaaccgacttcccatgaataagtcttttccggaacgatattggtgggaggaacgtctgctttgaattcatttgtaataactgaactattgaatgatccgtactggtattcagagttagtaaagtagatagacggtgtcgtattacctacgatagcgtatgatcctctaagtttaccgtagttataccaatccggtagatccaatgcttctgtaaacacgaaactcaaaccggcagaaggatagaagaaactacggttgccggctgtcaaacgagacgaccagtcgttacgggcagtcaagtcaagatacaggaagcgtttgtaagctacctgggcagaagcgaaaacagctcccaggaattcaccttggttaacgactttgtctctactggcacccttcgggtctctcttattattttctgatgagaacataccgttatatttcaaaccatgagattcccagatcactttcgattccgtgatatcttcaccggaaacacccaggttggcagatacatcgaaatcttcattgatagctttgttgaacatcaataagccttccacataatttttctggtagtgtgcatcctctttccggtaactaccttccagactgttaatgtctgaggggtctgaatatttggtaaagtattctttgttctccttgtcgtcacggtaacggtccgtaccaccacgcagacggaaagtcaggaagtcgaatatcttaagattagcagacaatgaagcgatcagacgttcgcggttctgtgtatattcgttttcattctgttgccacatcaggtatttgatgatgttatcgcggtttccggaactgatccctgagatctcatctgtcaggaagtagccttcatcattcttataattgtctttccacaactgagtgatctcgttacgaggcatcggatagtttgaaacacggtcgatacgtgtaggaggattctttgtttccgaaatgttgaacgaaacagaagcatcgaaagtcaggcgttcgtgcaccttaaagttaccggagaagctgaagttgtgcttgttctgtttgaagttttccaggtaaccgccatagttcatatttgtataagccagacgaatgctgttcttatcggtaccgttggtaatagagatactattgttgttgctgaaaccgtctttaaatacatcccggtagttgttaggctgcggagaatacgggcgtttcacgccatcccaccaaagcacttccgttccgtccatgcgtggaccgaagctacggtaagtatcaccgttatatatattctgaccgtctgcattcgtagtgaagtacggatttgaaccacctccgaacacattctgaagttccggcataaaagcacgctggtcatacgtataagatgttccgacctgaataccgaggcctttaccggcacttccacgcttagtagtgattacgatcacaccgttggttgcacgtgaaccgtacagagcggcagcgtttgcacctttcaggatagacatcgattcgatatcgtccgggttgatgtcgttaagagcagatccctgttgtgtctcgctacgttcgcgaccggcccagttggagtctgtatcgttgataggtataccatcgacaacgatcagcggacgtgtattaccttccaccgagttgataccacggatctggatcttggtacctcctgtaggtcccatggctgtctgctggatctgtacaccggcagctttaccatataaggaagtagctacgttttgtacgggaacagtctggagctgctccgctttcagttcactcatggcgtaaggaagggcacgtttttctttcttgatacccatggcggttacgaccacttcgtcaattttctggctgtcttccattaattttacatccagagtagcttgtccggtgtatttgatctcttgcgttacataaccgataaaagagatagacaaaatgcttcccggttccacatctattacaaagttaccatccatgtcggtaatagtaccctgactggttccttttatagatacggaagcaccggctacggggccaaatgcatcaataactgtaccttttacttgctttttttgttgagcgatgttagttacagtttccgacttagctcctgttgcatatacctgtccggtagaacagagagcgccggatagtaaaataagtccgataggtctcaatacttttttcataaacaaatctttaattagattcaagaaaatttaatttcaatgctgcaaatctataaagtgttgaatcaaagctatattagaatctgttgatagcatggtaaatcctgttggtgatggatattactatttatttgacggatattactattttaataatgggggtaggtggttattttttgtgttcttttacaaaaacaagcctaatacaggtagtataatcttttatatttacatgttatacgtatttatcttattgcttactagttggaaataagctatttttgcatgtaaatatcgtttgtatgagttttaagaacctctatcaattattgtgctttttactagtatttcctgtgtcggcaaaagatctttactttcaacatgtcgatttgaatgatggatttacgcaaccatcggcgatctctatttatgaagacgcaagaggatatatctggtttggtaatgataacttcaatgtgtatgatggaagaattgtccgttctttccgtctttctacctatatggatggtgtggaggataataatatccatgctatttgtggggatggggaggcgtttgtctatatgttggccaataaccggttgattgcttataatatgaggacggaagagttccgacggacggatatttcggcgaatacgttgacttatgagaaccggtatttgtattattcgtctaaaaatacactctatcgttaccggctcgatggggaacctgaaaaactgtatgcttttcaggactcgactatcactataagatctctgcttttatctgatgccggttggttgttgggaactaacaagggggtgtatgaatatactggaggaaccgttcgttccttgttggaaaacgaatccatttcttccttgtttaaggatgcacagaaccggttatgggtaggtacgggatcgaatggagtgagagtatataatgacggtacatggattgctctgcaggagaatagtccggtttgtccgcttgtcaataaccaggttcgttgtattaaccaggatattaaagggaatatatggatcggaagctttggtggaataacggtagtgaagccttctctgcaggactgttaccatttatctcataaagaacaagtctcctggtctttacagcattcatccgtttatgctatccaccgggatagccagggtgggatgtgggtcggaacttattacggaggactcagttatttcaatccggacacggaaaattatacattttacggtatttcaccgagtgaccccaatagtctgaacggtttcctgtttggtaaaatggcggaggataccaaagggaatttatatatagcaaccgagcatggaggactaaactcgatggatcttaagactcaaaagataaaacgttttgattccggtccttcgcgtatcccgtgccgtacaaccaagtcggtctggtatgatgcagaccgggacagattatatgtcggtacttttctgcgtggattgctttgctccacttcttccggaccttttgaacagataggggcggatgtattagttgaagatcatcaacagataattacagatctcataccctggaaagggaatctgatcgttgtttcccagggggggatatatttattggatcttgaaacgcaaaagctttcatggttgtttaccgatcccgacctgttgagccagacgggagttattatccgtgctgcttatctggatatggaggacaggctttggcttgctccggccaacagggaaatactctgtgtcagtatggatacccgaaaagtagaagatatactttctgtaaaagggatgatagggaaaaagccggtacaaagtattaccggtgacaatagaggaaacctttattttgttgttgtcggtatgggagtattgcgatatgagccgttgaatgatttctgggcttgctataaccaggagcagggacagctactgactaacgaacctttcaaagtgtgtgttacaccgatgggacggctattgattacatcgatacgtggaatcaccttgctggatatgaagaaaggaaaaagtacacatacgttgctgggaatatcttcaccgcttcacaggctgaattctaattgcggcgtatatatatcaccgaaagacagtacgatctttatcgggggagtagaaggtgttatagctacaaaagaatcaggtctggctgctacaactgtgccttatacgatttctttcaatagcttatatctggataatacgcttatgaccccttcttctgcttccactcctctaaaggaaggaatagcatatacatccgaactgactttaccctatgaccgcaacaatctgacaatcggctttacttccaccaattaccggtatgccgacaagaacctgtttgagtataaactggaaggattggataaacaatggacgcgaacccggcatccattgataatttatacttctttatcccccggaaaatatcgtttattggtacgtgaagtgggagagggcaagcagatcgctatggatatccggatacgtcctcctttttatgcctcagtctatgctttcggtatctatattttgctggctgtcctgtttctggtctggcttatccgctttaaccggagtcgtgccgtattgaaagcttcgttggaaatggaacatagggagaagctacgtatcgagaaactgaaccagatgaagttaaagttctatgtcaatatatcgcacgagcttcgtactccgttgaccttgatggtcagccagatcgatttgatcctgcagaattacgatttagggggaacgtttcgcaacaaactattgaaggtccgccagtataccggacagatgcagcagctgataaccgaagtactggatttccgtcgtctggaacagggtaagatgcctttccatgcaagcaaacaaaacctggttgccttcatacaacagatattcgattcattccgggattatgccgcagtgaaccatatccagtacaaattggatacggcagatgagaatatcccagtctggttcgacccggctcagatccggaaagtatttaataatttactttcaaatgcctttaagtttactccgaaagagggaaacataacgatcaccattctacagaaaaaggatattgcggagatacgtgtctccgacactggctctggtattccccagagccaacaagatcatatattcgatcgtttttaccaggcagataatgcttccggtgtatccctttccggtagtggaataggtctggcacttactagagaaattatattgcaacacaaaggaacgatcgaagtgcggagtgcattaggtaaggggactacattcatagtgactctcaaactgggagaacaacatttgaccgaagaacaaaaaacaacagaagccgcagcggttgatattttacctgtagaaacattgtggccggaggaagagatcgttttctccgattctctggataattcttctccggagataaaagagaatgcactttctgttctgattgtagaggataatgaagatttactgcaagttctggaggaagctttctctatcaaatataaggtttataaggctagtgaaggagaggaaggtatccgtattgccggagaaatgcagcccgatctgatcatcagtgatgtgatgatgcccggcatgtcgggtacggctatgtgccagcggttgaagaagaaatttgaaacgtcacatatcccgatccttttactaacggcccgtacggatctggaaagtgccctcgagggtatgaagtgcggagcgagcgattatataatgaagccttttaatctggaacttcttcttttaaaatgtaataatgtgatcgctactttgagacggcaacaggctcgtttctgtaccgaagcggaatcggcaccaaccgatctggctaccaaccgcctcgatcagcaattacttgaagactctgtccggatcatcgaagataatatggagaataaagatttcaatatcgacatgtggtgtcgtcagattgctatcggacgtacccgtcttggtggaaagataaaggcgattacagggcttaccctgaatgattttattcttcagataaaacttcgtaaatgtgcttccctgctagaaaacagcgagctgactatctcggaaattacatggaaagccggcttctcgagccccggttatatgggtaaatgctttaaggaatatttcggagttactccgatgcaataccgtaatggtaaaaagaaaagccgctccgaataaaacggaacggcttttagtatcttattataccttattttttgtgattatacattgaaacggaaatgcatgatatcgccatcctgtacgatatattcttttccttctacgctcatcttgccggcctctttaacggcagcctcggaaccataatgaatgaaatcatcatatttgatcacttctgcacgaatgaaacctttttcaaaatccgtatggatcacaccggcacattgaggagccttccaacctttttcgaatgtccaggcacgtacttcctgtacgccggcagtgaggtaagtttgcaggttcaataagctgtaagccgatttgatcaaacgcgctacacctgactcttccagcccgatttcctgtaggaacatctggcgttcttcgtaagtctcgaactcggctatttcactttcaatcttggcagctactaccaggatttctgcgttttcttcttttactgcttcgcgtactgcttctacgtatttgttaccgtttacggcgctggcttcgtctacgttgcagacatacatcaccggtttactcgtcagcagaaagagttcgtgagcaatcttttgttcgtcttttgtttcgaacgtaactgtacgggcactctttccttgttccagggcttctttgtattttactaatacttcataagccagttttgcctgcttgtcaccgcctgtctgggcttgtttctgtactttggcaatacggctatcgattgtttccaggtctttgatctgaagttcagcatcgatgatctccttatcgcgtacagggtctaccttaccgtctacgtgtacgatattttcatcgtcgaaacaacgtaatacatgcaggatagcatctgtttcacggatatttgcaaggaacttattacctaatccttctcctttactggcaccttttaccaagccggcgatatcaacgatttctaccgtagtaggaacgatttgtttcgggttgatcagctctgccagtttgttcagacgttcgtcgggaacggtaattacacctacgttcggttcgatcgtacagaacgggaagtttgcagactgtgcctttgcatttgataagcagttgaaaagagtagattttcctacgttcggaagacctacgatgccacattgtaatgccataaaatatatattgttttattatctatttgcaatatttctttgtaggagctgccatccgacagctttttcagtttgcaaagataaccaatctttcttgtatattattcaagaacaagtaatatactgtcttttctcatattgcattctttaccaaagatattttgaaaagtaactatcatactatcattttttaattaatagtttgtataatagatgtttatcttatgatagttgccagaaataactatcattccatctatcataactatcattcatagtgtgtagacttatgactttttttgactaagtatatgacttaaaaccagtaagataatgatataagttcactgagatccgggtctcgcccccttttgcacccgggtgtgagcatcgttgagatgggggtgtaaaaaggggcgaaataggggtgttgtctactatttgtagctatatcgctcaaattaagtcacctgtttcagataaatatctaggatgaggcgggatctaaaacgatatatttaatgtgcctccagccagttgttcccttcgccgcaatcggcaatcagaggaacctgtaacttgatcgcaccttccatttcttccaggacgatctgttttactttctccaattcatcattgcagacattgaagtttaattcgtcgtgtacctgaaggatcattttgctttttaatccttctgcttcgaaacgcttgaagatacgtaccatggctaccttgatgatgtcggcggcactgccctggatgggggcattgatcgcatttcgttcggcatagccacggacgatggcgttgtgcgaattgatatccggcagatagcgtttgcgtttgaagatcgtttccacataccctttttccttggcaatgcggatactttcatccatataatcgcgtacgccgggataggtcttgaaatagccttcgataagctctttcgattctcccctggggatgttcagccgttcggcaaggccgaatatcgagatgccgtagataatcccgaaattggctgttttggccttacgacgcatatcgctggtcacttcctctaccggaatgccgtatattttagcagcagtggcagcgtgaatgtctgctccgctacggaaggcttcgatcatgtgctcgtcattactcagatgggccatgatgcgcagttcgatctgcgaatagtcggccgagaagaaggtacaatctttactatccggaatgaatgctttgcggatttcgcgtcccagctcgtcccggatagggatgttttgcaggttcggattggtcgaactcaggcgaccggtggcagtgactgtctggttgtatgaggtatggactttccctgttaccggactgattagttccggcaaggcatcgatataagtactcagtaattttttcagcccgcgatattccaatagcttacttacgaccggatgtttcccgcggagtttttccagtatgtcttcgctggtactgtaactacctgtttttgtctttttggctttctcttcgatcttcagacgttcgaaaaggatttcaccgacctgcttactggaattgatgttgaacttcacaccggccagctcatagatttctttttccaattttttcagggcatcggtcagttcatccgacgactgcttcaaggcgactgtgtcgagcttaacgccagtctgctccatttctgccagtacatatattaatggcatttcaatatcgaagaagagcgattcgattccggttttctcgagctcgggagcgaagaagttttttagcttcagggtaacgtcggcgtcttcggcggcatactcggcaatttgtgccaaaggtacgtcgcgcatgcataactgattttttccttttgaaccgataagctccgtgatggggatcggtttatatttgagataggtttccgccagatagtccattccgtgtcgcaactccgggttgagaaggtaatgggcgatcatggtgtcgaacaacggaccggctacccgcactccatacttgcggaggaccatgatatcgaatttaatattctgacctatcttttgcgatttgcgattttgcagggcaggggagaagtgggctattactttggccgcctcttccttgtcggccggaaccggaacgtaccaggcttcattttcctttacagcgaacgacattccgaccagtccggctgtcagtggatcgataccgtcagtttccgtgtcaaaagcaaaaaaatcctgatccattaaaaattgacctaatttagctctttcttcttcagaatcaacgactttgtagttatgaggtgtcgattttaagttcgcgagagtcgaatattttggaacactcggctcctcgggtgcaaatatgtcaaacagagagccttgaacagggccctttgcaactttcgttgcggcaggctttttctcctccgaggttagtttgttaataaatgttctgaattctaattctgtgtaaatctcagtcaaccgggcttcgttcggtttttcgcggatgcatttcgccgcatcgaactggatgggcacatccgtcttaatcgttgccaggaatttggagaaacgaatttgctctacattttctgttacccttttatgaagtgcccctttcagtttatcggtattctccagcaggttttcgatcgagccatattcttcgagtaatttttgggctgtcttttctcccacacccggacaacccggaatgttatcggaactgtcacccatcaaacccagcaggtcgattacctggtcgaccgaggtcagcgagtatttgtcgagtacttcttttacgcccatcacttcgtagtcgcctccaaatttgggacggtacataaatatatggtcggacaccagctgtccgtagtctttgtcgggtgtcatcataaagacttcgaatccctctttttctgcctgcttcgagatcgtacctatcacatcgtctgcttcgaaacgggggacttccagtatcgggatattgtatccttcaataatatctttaataataggtacggattgccggatcacttcgggggtttcttcccgctgtgccttgtacagttcgtatgcttcatgacggaaggtaggccctttggggtcgaaagctacggcgatatgtgtcggattctcacgttttaaaacgtcttccagactgtttataaacccgaaaatggccgatgtattcatgccttttgagttaatacgcggatttttaagaaaagcgtagtatgatcgatagatcagtgcgtacgcatctatgaggaataacttcatctcttttaacacgttttagggtgacaatagacggtaaatgtacgaaaaaactcgcttactcaatactttttgttaattttgcgaatctttggatagaatatgaatgatagaaagaaaatagaagaaccggttgcggaagagtttaagcgctttaacgatgaatttgcggattcacttcgtagtgagacgcgtagattgcaagcggctatcgaccagatattgcatgccagcggtaaacatgttcgtccgttattggtattgcttacggcaaaagcttgtggaaaagtgaccgatcatacgatcaattcggctgttttcctggaattgctgcatacggctacactgatacacgatgatgtgatcgacgaaacgaagcagcgtcggggagtgccttccctgaatgccattttcgataaccgcatctctgtattggttggggattatgtcctttccacggctttgatccgttctattcagacaggcaatctgcagatcataaatatcgtatcgaatcttgggcgcgacttgtcggagggtgagatcaaacagctcgaaacagccgaagaaactatcctggatgaagcatgttatatgcaggttataaagaaaaagacggcgacgctgctttcttcctgtacggagatcggtgctatttcggcagatgcttctcctgaaatggtaaagatatgtcgtaagttcggggagtatctggggtattgtttccagatcaaggacgatattttcgactattataaagaaatgaatatcggaaagcctaccggtaatgatattcgcgaaggaaaggttactttgcctttgttgcacgccttggaacagggtaggagagaagatgtggaatctcttctgaaagtgatccacgataaggatttttctgctgagaatatcgatgctttgattgagtttgccaaagccaacggtggtatcgaatatgcagaattgcggatgaaggagtatcgtgataaggcagtggaggttcttatgcaacttccggaatcggatgcccggaacggtcttcttttactggccgattatatcatggaaagacagaaataagtaaatgttcagatataaaaaaaggttcaatccatctacggattgaacctttttttatgtcgactgtctactttatttccctagtctgtgctcgatatcttccaccaggctgcttgctccgatacggaataattcgttgttcagccattcattgcctaatacctcttttacgattgtatagtacttaactgcatcctccgctgtgcgtactcctccggatatttttatcccaactcgtctccctgcgatggaatggtacgtttttagtactttgcacatcgtataaacggcttccggtgttgctccgggataacccttgcctgtggatgttttgatgaaatctgcgccggaatagatagccaggatggaggctttccggatattggcagcagtagccaatgcgcctgtttccagtatcactttcagtttggcttcgcggcaactttctttaatctcctgcaattcctcggcgatctcttcataattttcttccatgaagtaacccagattcatcacaacatctatttcatcggctcccgacataacagccatagctgtttctgcgatttttacttctataaatgtttgtgaggaagggaatcctgcagcaacggaagcgatcttcacattctgtgcggctaatgcctgctttaccgtttcaacgaagaggggataggtgcatatcgctgccacgttgggaacatcaggacgggtaccttcgaaatcattgaccttatctaccagtttccagatgctttcttttgtatctatactggtcagggaagtcaggtcgatacatccgtggatctgttttaatacctcgggtgtgaagttctccttgtagtgcttttcaacgagtgcattaaccgtttccgttattttgctatctgttgctaccggttcaaatttggtgaatgcttcatggtatttatccatctggtcgtcgtggtcatgatcatggtcatgtccgcaactgcaattgtgttcgtgtgccatcgttataattttttattgtttatatgtcgttctttatcccggtcggttttcttcagcagattcttttcgaacgctgctgtcaggtctacgccggtttggttggcaaggcagagtagtacccataatacatccgccatttcatcgcccaaatcgcgatgtttatcactttccttaaaggattgttcaccgtaggtacgagccatgatacgggccagttcgcctacttcttcggtcaggatcgtcatattcgtaagctcgttgaagtagcgtacaccgtatgttttgatccagtggtctaccttttcctgggcttcctgcagggtaatatctgccatcttattctttgttttgcgagtcgatcaggattgtgaccggcccatcgtttaacaattctattttcatatctgcaccgaatgttcctgtggcaacatccttgcctagttgaagtcccatctccgcacagaaagcttcgtacatcggtatggcgatatccggtttagacgcatggatgtaggaggggcggtttcctttctttgtagacgcgtgaagagtgaactggctaacgaccataacctcgccctttgattcgatcacagagcgattcataaccccgttttcatcgtcgaaaatgcgtaggttcgctattttcttgcataaccattcgatgtcctcctgtgtgtcgcgatcttcgatacctaccagcacgagcaatccgtttcctattttagactttaccagtccgtcaatcgtgacggagcaatgtcgtacacgttgtataactgttctcatttatatgtttactttaaaccatttattaatgcttttgttttggcttctccgattaattcttttaaatcttcaaagcttgcttcacgtattctttttacgcttttataatggcgtaaaagcaatactttcgtcttttcaccgattcctttgatgctgtccagttccgagcgagtctggcttttactgcgcttatccttgtggaaggtgatggcgaagcggtgtacctcgtcctgtatctgtgtgaagaaccggaacatctggctttgtatctgcatgccgactgtgaccggtggaaagccgaagagcagttccgatgtacggtgcttgccgtctttcgctaatccggctatgggaatatccagatgaagctcgtcctgtatgacttcacgaaccacctccatttgcccttttcccccgtcggtaaggatcaggtcgggcaggggagatccttcgttgatagcccgctgataacggcgacggactacttctttcatggaggcgtaatcatcggggcctactacggttttaataatgtatttgcggtagtctttcttcgatggtttcgccattttaaagacaacacaggctgcaacggcatcgctaccctgtatattcgagttgtcgaaacattcgatatgtattggcagcttgggtaaatgtaaagcgtcctgtacctctttcaatatgcgtgtgctgcgttgttccggattcagtttttccgcttgtttcaggcggtctactttgaattgttttacattcatttctgaaagttccagtagcttctttttatcgccacgctgtggaacagtaaagctgacattgcccagttccatatccggatcgaaaggaacgatgatctcccgggctgtacttttaaaacgttcgcgcatttcaataatacccaggctgagcagttcttcttttgtttcatccagccgttttttatactcgaacgtgtaagcctgcacgattgctccgtttcctatatgcatgaagttgatataagctgaacgttcgttttcggcgatagagaaaacatctatattgtgtaacatgggagttaccacggtcgattttgcccggtagttctctattacgtcgtatttctctttaatcttttgagcttcttcgaacttcaattctccggcaagcgtttgcatttcctcataaagatgtttgcttatctgggagatattcccgcgcaggatctcttttatttcggatatattctgacgatattcttccagtgtctgcaatcctacgcaggggcctttgcagcgctttatatgatactccaggcaaacgctgtatttcccttcggcaatcgattccggtgtaagcggatatttgcaggtgcgtaacggataaagttctttcaacatttgaagcatgacttttgccgtatatacggaaggatagggaccgtaatactgcgaaccgtcgcgcactatatttcgggtttgaaatatacgcggaaagtattcgttttttaccacgatagacggatacgttttgtcgtctttcagcattacgttataccgcggacggtattgcttgatcagattattttcgagtaataaagcatcctcttccgtatctactacgatatatttgatgtcgcggatttgctttaccaatacccgtgtcttattgctgtcgtgttccttgttgaaataggaggatacgcggcgcttcaggttcttagccttgcctacataaatgatcgtacccttgtcgtcaaagtactggtagcatccaggtttgtccggcaggatagaaaggatcatttttatatgtttgtcggtttctgaactcatcttgtttaattgtttctggcctattcccagtgttttacctccttttacctaaagcaaatgtttcacgtggaacaattcgcgttttatcttccgagtagcaccaacaggatgtttatatcgcttggagagataccagggatacgacttgcctgggcaattgtatccggatctatcttggttagcttttgccgtgcttcggtcgataaagactggatcgaattgtaatcgaatttgcctttgatgtggatattctccaaacgatttatcttatctgctatgatctgctcgcgccggatgtacccgctgtacttgatcaggatttctgccgcttcgataatctcttctttacgtgaaacgggaaccttgtccagttctgtgcggagtgccggaacgagggtggcaatactttccatcgtgagctgcgggcgaaggatcaagtcgattagcttgcagccgtgagcgagtggggtagtacctagtttctctaatccgtcgtttatatattgcggcttcacagaatagttttctgcaaaggagataatagcatccctgtgtccctttttctctttgagcaggtcgtaacggtcttgtttcgctaaacctattttgtatgctttttctgtcagacgcatatctgcatcgtcttgtcggagcaggatgcggtattcggcacgggaggtaaacatccggtaaggctcgtctacaccttttgttaccaggtcgtcgataagtactcctatataggcttcatcgcggcctaatacgaatggtttgccaccgtggcagtttatatgtgcattgatacctgcaatcagtccctggccgcctgcttcttcatagccggtagtaccgttgatctgtcctgcaaagaacaggtttctgatctgttttgtttccaagttatgatgtagctgtgtcggatcgaagaaatcgtattcgatcgcatatcccgggcggtaaatttgaatatccctgaatgcagggatggcttgtaatgcacgcagctgaatgtctaatgggagagaggaggagaaaccgttcaggtaatattcctgtgtcgtttctccttccggttccagaaacagctggtgttgtgttttatctgcgaaggtgacgatctttgtttcgatactcggacagtagcgcgggccgatgctctggatctgtccattgtacagaggagagtcggggaggccttcgcgaaggatttcatgacaagcttcattggtgaatgttgtccagcagctaagttgctttaacgggcgtggctggaaatcgaggtatgagaatttgtggaagtcattctctcccggttgttcccccatttcatcgaaatgtatgctgcggccgtcgatgcggacgggtgttcctgtcttcatccgttcggatctaatgcctacggaaaccaactgttctgtgagtcctgtggctgccggttcggagatgcgtccgccgcgtaattgcgtgcgtcctatatgcatcaatccgtttagaaatgtaccgttggttagaaccacgcttttggctcgaaactcaacgttcatattggtcttaacgccacaaacggtattcccgtcaagtaatagctcctgaacggtatcctgccagatatatagattcggaaggttttccacgatcccccgccagcagtcgatgaagcgggcacggtcgctttgggcacgcgggctccacatggctggtcctttgcttcggttcaacatacggaactgaatagcggtacgatctgtaacaatacccatataccctcccaatgcgtcaatctcacgaacgatctgtcctttggcgataccgcctacggccggattgcaactcatctgtgcaatcttgttcatgtccattgtgataagaagcgtttttgaacccaggttggcggcagctgctgcggcttcacagcctgcatgaccggcacctaccacgatcacatcgtaattgaaagtcattgtcgtaattatctttgtttcttctgcaaagatagtcatactccgccttttagtcatcatcccaaaggatattttgcttatgctttgtttcgttaaaggtttcggtcataattcctttaaaacctccatcacatagttccgccgttgccgggagatagggatggacgatctgtctttcatgcggatatatcctccgtcgcttttgatgaagcttttgatctcatccaggttgatcaagtgcgattggtgtacgcgcaggaaatgatagggagttaatagctcgtcgaattcttttaatgttttggagacaaccagcttctcacctgtctttagatagaaagtcgtatagttgctctccgattcgcaacggatgatggagccgatctctacaaactctattttatcggcgacagacagtgctattttcttttgtttgtctatcgcccgtgtgttctggaggaggttttgcatccgtttgttttcctgtttccgcaatactacctggacggctttatctacggcatgtgtcagctcctccgggtcgatcggtttcaatagatagtcgagtgcactgaaacggattgcctggatcgcatagctgtcgtaggcggttacaaagatcacctcaaagggaatatcaggaagactttccagaagggaaaaaccggtatcgtcacccagccggatatccaaaaagaggatatccggttttgcttcgggcaggacggtaagagcttccgtaacggaactgcagatggccgatatactgatctgcgggcaataggtcccgatcatacggagcaggttctcccggttaccctgctcgtcatctacaattgttgcggttatttttgtgttcatattttgcgttataaaggaatggataaccggacatggcaaccggagacagcttctttttcctgcctattttcgattgtaacaccgatttccgtgttgtacaaagtctttaatatttcgaactcgttggtgacggcacggataccgaaacctccgttctcttctgttttcagtccgggaccatcgtcggtaatgtcgattatcaacaactggttttgcaaagataatcgaattgtgatctctccggtacctcgcggggcgattccgtgtttaactgcattttcaacgaaaggttgtatcagcattcccggtatctcgatcgtatccggctggatgttttcgtctactgtcagggagtaggagaaggggaaacgtagttgttcgagtttcaaatataactgtagctgttcgatctcgtcggagaggggaacaagcttcttttcggacgtagccaataccttccgcagtaaacgggagaagtcgatcagatatttattcgcctcctgattggcggagcggttgatcagattctggatcgagctgagtgcattaaagatgaaatgcgggttcatctgcgaacggatcgcacggagttcgagttcacggatacgacggcggttaagctcctgcttctgtttgcttttggtccggaaatagtaaataagaccgatgatcgcagcgagtaaaagcgcacctataacgccttctttgaatccttttatgaaatcgttgaaggatttatcttctctgctcaggtctttttttactaaatcgatgattgtgtctatgtcaaaatcccagagtctccgatagagaatagttccgtcttcgcgcatcagaatggtgagtgggtagatacccttagactttaaatcttgtgcttgctggctgggtatagctttgtatggctttaccttctcagcattatgagaggagaaatttgagtatagttcgagttgtatggtcgaagttagtccttccgcttcaatacgctgtttcaagtcgagtgcgttttggagattattggcgggaagaccatcccatggcaatagttgtaacaggatgtatttccggtcgtttcctttcgccaggtgcaggctgtcagctataatcagaccggtttctttaatattctttccggcttcgaaaggtaacagcttgttgtatgtattttttagatcgtttgtcagactggtatccgggcaggagctgataaaatccttataatccgcatctaattcggatagcattttttcacccattaaagcctttagattaattttgtttacttgatatttaggataacctgaaaggatttgtttcgttaatagatagtcttcctgtggggttaattctttttgcttgttcagacgtagattatccgacttgagttcctgttttttatagatagtatactcatacagaaaatagtcataatttgcagcatccggtttttttaggttgtatgcataatcgataagtggattgaccgatgcaaagtggggggcttgccagctgagcaaaccgcttttatgccaggcctctttgtcggtgtaatacatatagcgttgtaggataatagctcctttgagatactgttccgagcgttcgaatacctttcgccaatagggatccatctttccaaaatctttctctaagacagtttgaaaaagagcattacgggactggaaggctttttccagctggtcgggttggctgaggttaaaagcatatatgtcagactcatagagattggcgaaccgtcgatagccatattggaagttgttttgctcgtttcctcgtccttcgtaacggatgcgatgtgtatctatatatagttttttgtcctgaacaatggaatctccgggagttagtagtagcgttttttgtgctccgactttgtattctgtcgggtaggggataaatatttttttatgaacggttgaatctccggatgtgtcgagatctaaattgcagcaggtaaattccgtatttggaggaagagggaaggaggcttcgataattcgtgtattcggtgtcggaaagttaggtaggccctcactccatccggtcagaagatcgttggctgtcgaggtgacaagcttgtccagatttaaagaatcctgaacagatacatccgtattggctgataatccctcttgtcttactccgaaaggaatatacgttttcgaataggagtagagtgagttcgttctgtcgaaagtgagtgcttttccactcttccgatcgtatgtggcatgtagaatctgtttgtcagaggtactgtctttaaaaccgaaatcctgctggtaacgattgtcgaaataataaaatccctgtttctctttatcattgtgacaatcatacaggttatccagcgtataatcgatagaaatggatttatctgatctatctgtcactgttgcccggacaatgaccctccggatattctctgctctccagggaatctcttcctggattcccggtgccacataaggataataatgaacacactcaaaagtgaaccaatccccttttttaagagaatcgcgactgtaaggagtgaatgattccgcccatccgttccatgccagacatacgaataaaaataagagccttactttcatatctgtaaatttaagatgaaaaattagattacagaccaaatgtagaaagaaagactcttgcgtggccggaaaatgagtaaatggtagttgcgagtgagtaataatgtaacatttgaacataaatataaataatgaactgaataggatgataaagaataaaaaaatactatgtttgcatacataattattaataacaaatccgagactatgaacaatttaattaaagcggacaatgagtatcagcaatggttggctaatctcaaaaaacgtatcaaacaaagtcagataaaggctgctgtaaaggtaaacactgaattattagaactatattggagtataggttctgatattgtaaagaaacagaccgaatctgattggggagatggaattattgaacaactaagtcttgatttacggctggccttcccggaaatcaaaggtttttcttctcgtaatttgtggtatatgaagaagtggtttttgttttactctggtgaaaatataaaactgcaccaagttggtgcagaatcttcatcaaagatgccacagcttgtagcagaaattccatggagacatcatactgaaataataactaaatgcaaatctatcgaagaagcattgttttatataaaaaagaccttacaggagggttggagtcgtgctatcttaattcattatataggagttgatttatatagatcgcaagggaaaactatttcaaacttctcctcaactttaccttctttacaaagtgaacttgcacaagagatgttgaaagatccttacaatttcgattttcttacattaacggaaggatataaagaaaaagaattggagaaggctttaacagacaatcttactcgatttttattggagcttggaaccggttttgcttttgtaggacgtcaagttcctattcaggttggtgaatcatcttattatattgatatgttattttatcatttcaggatgaagtgctttgttgtagtcgaattaaaaacagtgaagtttgaacctgaatttgcaggtaaattaaatttttatgtaacagctattgatagacagatgcgggataaggatgataatccgactattggtttattgatatgtaaagacaaagaagatgtaattgctgaatatactttggcagatatacaaaaacctttaggtatatctgcttatgatctgaataatattttaccagagacatttagaagcagtcttcctactattgaggaaattgaaaagaatatgaagaacttttgatataaatagataaataataatgccgggatcactcctcccggcattcctccggcaaaatagccaaagccttattttcgttttcttccatgatctccctctcccccggtcctttatcgttgatgccgcatagatgaagaattccgtggataatcgtgcggtgcagttcttcgttgtaaggagtttcgaacttttctgaatttgtttttactgtatccaggctgatgaagaggtcacctgatattttgttgccgctggtgtaatcgaatgtgatgatatcggtgtaataatcgtgttgcagatactggcggtttacctccaggatcttttcgtcggaacaaaagatatagctgatatcccctgtctttttcccgtatgtttctgtcaccgctttgatccagctgctgacagccctctttttgatagccggaagttcgatgtcttccgcgtaaaatgatattgccataatgctattattaatcttgtttctttatcagaatgatttgttaaaaaatattacccggtatactaattccaattacctgcactagtaatccgatttacccggtatagtagtgacattttgataaaacggaatttactgggcaaagaataaataagtgagtgctattgctgcaatagctcctgccaggtcggccagtaaagaacattgtacggtgtaccgtgtgttacggattcctacgctgccataataaagagccaccacataaaaagtagtatcggcagaaccctgtacgatcgacgaaaggcgtccgacaaacgaatcggctccatatgttcgcatcgcatccagcatcatgccacgggcaccgctaccactcagcggcttcatcagtatggttggcaacccgccgacaaaatcggcattcaaccctactgcctctactcctgtccggatacctcctatcacaaaatccattgcacccgatgcacggaatacgccgatggctaccagtaccgctatcaggtatggaatgattgttatggctgtcttgaagccctctttggccccttcgataaatgtgtcgtagacattgatctttttgcgtacgccacttacggtgaatccgcagataatggtaaacaacaacgtattggcgaagacagtcgaataaagcgatacctgttcctgctccagcgagttgaataaccaaacgagtcctccgatgaaagctgccatacctccgaagaataacagcaggtttttctgaaggatattgatgcgctgtttgatacaaacagccaggatagctatcagtgtggaagtaaatgtcgccagcatgatcggcagaaatacatccgatggattggcggctcccaactgtgccctgtacatcatgatcgtgatagggatcagtgtcagtccggaagcattgatacataaaaacatgatcatcgggttgctggccgattccttgtccgtattgaattcctgtaactgttgcatcgcttttaatcccatcggagtcgctgcattatccaatcccagcaggttggcggagaagttcatgaagatagaacctgttgccggatggcctttggggatatcgggaaagagcttgctgaacaccggagcagccaaccgggcaaacgactgaatcacccctcccttttcacctatcttcataatgcctagccaaagcgacaagatacctgttaaccctaatgatatttcaaatccacttttggctgagtcgaatgtggcattaatgatatcggtgaataccactgtatcgcctgcaaagatcagtttacccagtgcgacaacgaatgcgataagaaagaaagcaatccaaatgtagtttagaaccatactgttttaatattatgctcacaaaaataggaatttattaacgatagatttgtatttttgtccgaataataatcgtaatgacttatgacaaagatattagtaacctacgacatgttccgtgaaggcttcacggaactggaaaacaagtatgatgtgacatttcccgacggaagagattttacttatgaggaagtgttcgaaatgattccggaatatgatatattgtgctccatgttcgattttccggtgaacaaagaactggtagaccatgcaccgaatttaaagatggtagctaactatgcggtgggttacaataatatcgatgtggcttactgcctggaaaaaggcattacggtagccaatacccctgacccggtgaccgctcctactgccaacctggcactcggcctgatgatcgacaccgcccgccgcattaccgaatgcgaccgtaagttgcgcactttaggcaaggaaatgaaaataggcgtactcgaaaatctgggtgtgaatattaccggacaaacattgggtattatcggtatgggacgcatcggaaaggcccttgccaaacgtgcgaacgcctgtggcatggaagtgatctaccataaccgccgccaattatatgtggatgaagaaacaaaactgaatgtaatgtatgcttctatggaagaactgttggctaagtccgacttcgtctccctgaatgctccttatacccctgacacctatcatatcatcggtgaagaagagttgaagcaaatgaaaccgtctgccatcctgatcaatacagcccgtggtccgctggtagatgaacaggcgctggtgaaggctttgcaggacggaacgattcatggtgccggcctggatgtgttcgaattcggcgattatccgctaccggaattattggaaatggataatgtcgtattgaccccgcatatcggaacgcagacactggatgtacgtatcgtcatggcccgtacggtttgtaataacgtcatcggatttttggaaggcgaccgtcctgtatcacgtgtcatgcgtccatgacggcggagtttgtattgagcgaacttctctcgatggcgaatccggagaaggctgctttcctgcaacgtttctttaaaacggggccgggacagtatgccgaaggcgatgtattcctcggactggttgctcccctcacccgcagcatcgcaaaggcgaacaagcaaacacctttggcggaattgcagaaattgatggatagcgaatatcacgaagcacgcctttgtgcccttttgatcgctgtcgagcaattcaaaaaagcttcggaagttgaccggaagaagctgtacgatttctatctcggtaatgcccgccggatcaataactgggatctggtggatgtcacctgtccgcatctggtggggctttacttgctggataaagaccgttcgcggttgtatgaactggcggaaagcgattgcctgtgggaacaacgcatcgcgatggtttcgacggtgacgtttatccgtaaccgtgaatataccgatacgctggcattggcggaaaaactgatgtcgcataaacatgacctgatgcataaggccgtgggttggatgctccgagaggtcggaaagaaagaccgggaaactttaaccgcctttctggaagagtacgctacccgtctcccccgcacagcacttcgctatgccatcgagcattacccggaggatcagcgtcagtatttcatgaagaagaaataacagatggatgaacagataaaagaaaagcttcgccgttgggcaaaagaatataacgtagatacctttatcccggatgatccggtacagttcccgcaccggtacaccgagaaaaaagacatagaaatatccgcttttctcacctcctggatctcttacggacgacgggaactgatcctgcggaaggcaaacgaactgcatgcggtgatgggcgtcagtccgtaccgctggatcatggaggaaggttataaagacttgccgggaaatgcggtggaaccgggcaaaagggatactttttaccgtttctacacctactcccatctccggcaattgtgcgagcggttgaaaagtatctatgaagaacatgaatcgctggaagatgcattggctgccagtcggtaccccaatccgattacgaagatacaggatgtcttttcgggtatcgaaggtattccggtattgaccggtacatccgcctgtaaacgtctggctatgttccttcgctggatggtccggaaagacggtattgtcgatttcggaatctggggaacatcgatacgaccccatgaactgatcattcctttagatacacatgtccatcagatatccctggaactgggactaactgctcaaaagaatgccaccttaaaaacagccatcgagataaccgaagctttgaaagaagtctttcccgatgatccgtgtttgggggattttgcgttgtttgggtatgatataaaacggttgaaaggcaagaatacacgtttattctatgatggccaggttgacctgcggggtacggatacccggttttaattcgccgttgacgatgatgaggctgtcgcctttgaatatggctcctgctccggcacgggctaatggttcgtaatcgcccagatcggtccattctttagtgaacgtgttgtattgtaacaaagccgtgttgaatttgtaccattccaccggatgatacatataggctttgccttcctcctgtaacgtattgaccaaagtcgtgtctcctttggcttcggctgcctcgatcagtttcgggcggttgacggcagtaaggaaacggtcgtagttgacaccacccatcagcaggattgaactgtcgctataagagacggcacaacctccggtgaaggtgcgatgctttccatctttgaatgagggtagttctgtttccgttctccatgtttttgttgccggatggtatgagagcatatcgtgaggtacgatcgcttccgtatcgttctgaatgggctggaaacctccggccagatagatacgtacaccgtctgctgacttttgggctgctaaaacaggctggacgcgggtggctcccgggaagtcgggcaggtttacccaattgctttttgttgttaagtccatggagaggaaactattgcatggaagcgtattttggtttcctccggccacatacaccgtgtggtctgtataggttgcagaaagattgtccatgggggccggaagagatggcagtgtattgatttccgccttttcatcggtcgtattccaggataacaggcgtacatccgggaagagggtgtcattattgttgcctccgatgcagataataccttcgggggtagtaactgctgcaccgtaggctaccggaaaaggtagattgcccgcttttttccatccgctggccggattggaaaggtcgagggcgaatatgtcgctgtagtattttttagctcctccttccgtgacaggtttgtcggggaagttgcaaccaccggctaccagtagcattccgttacttatgccggtaaacggagccgatactcccagtgatgcggtgtctgccatgcccggcaggtcgggtaatttattccagttgatcatgatgtttgttgttttttcagatgtagaatggttacatcctgccagtgaaaagagcagcaggatcagccatccggttactattgatttgtcgtacatcttgttattactataaagttactctttggatttgaatgtggaagccggaagttcgtccccgttcaccagattggcacgggtgaaaggctgccatccgtagcggactaattggggacgggcgattttatcgctccggactttgacctttccatcgacaatttcagcctctgcctgaacaaataacccgtcgtattcggctatttcaaaggtccgtatcggctgtccgtcggaagtatgcaagccctctgcataatcaaaggtgatataggcggcatcgtccttgaactcaaccgaacggaagagtgggcctgacggaatgatccgatgtccgtaggttcggtttaaagcccaacgtgcgagtcgctcccctatttcacgtttgtatctcggatgtacattcaacgaatctccccggtcgctgcttaccgccatgccgcaattgggaatttcttgcatcatccggcgttggctatcacggaaccaggtccagctcggacggtcgatactcgacagttgaacatagtagaacggtagttcctcttgccagttctcccgccagctattcaccagcaatgggaacagacgttcgtgtgtctctatattctgtgcgttcgattcaccctgataccagatgattcctctgatcggatattgctgcaacggctcgatgcctgtctcatacaggtagcagggttcgtacggatgccgttgttgtttgttggtcgatttctttatgttgagggcggcacggccgcgtacccaatcctggatgaaatcgttctctgtccagttatacaggatatcggtgaagtcgaactccagtgttttccggtctatccatgcttctgtacccgaacctccgacagcattcagtatcagaccgaccggaacttgcagactatccgaaagcatctgtccgaaagagaaagctacggcggagaatctatcggctgtttgttcgttacatgttgtccattgcgtgtcgtggtaatattgcagtcggttgagcgaatccattaccgcttcatcccattccaccgcattcgtgaaccagcgtggctccatgttgaagagacgtatttgcggttgtttaccggcatatccggtcaattccttacgctggctgtctaccagttcgtctacccggaaagccatgttcgactggccggaacagagccatacttcaccaaccagtacatccttataagttagtttttgcgatgccggagttttcttcttgttctttttttctaccagtaaagaggtttcgatagtcagttcataagggcctcctgcctgcatcgggtcgagtatgaccgaccatttgccgttggaagcagttacggtttctttcttttgtccggcaatctgtacggttactttttcacctgcattggctgttccggagacgggcaacggcttctcacgttgcagaaccatcttatcggagtaagtgaccggcatttgcaggcctccgtagttgcctgtcagctcctggtagatcgtcttggcaaggataccggctccttccgcagtcggatgaagggcatccggcaacaggtcgggacggttgtacaagccggcctgtaagtcgatcagtccggtgttggccaggcgggctatctcttcgatggtttcctgttccatccagtaccagtcgcgtgtgcccgacttgaagcgtggatgacggtgtgagatcggtgtcatccggcagatccatatccggcaatcgggatttgcctgacggaaagaattaatcagggccaggtagtcgcttacgaagttatccctgtaattgggccagttgcgcggatcggtatcattcaatccgagatggatgattacccggtcgccggcaaagtcgagtgctgctttgtattcctcctggtcgcaatagggacggtgccctttgttgagtagcgtagcaccgcttttaccgaaattcaccacttcgtatccgtcacccagcatgcgctgaagttgagccggataagcgtttacttcccggttctctatgcctgcgccgtatgtcacactattgcctacgcaggcaacctttaccttcttttgggcataggttgctgtgcagagtaacaggcataataataaaagagtttttttcattgtataataatctatgatctgcttatttctttttatcgggtgaatagatcagtccgtctaccgccttttcaccgtcaggagtgacaaatacgaaggtgaacatccacttgacaagccgtacttccggtaaactgaatttaccgaccggcagtttcataaataccttgttccatcccttttgcaggtgaactttagccgggtcacggccaacgcagttctcatttcccagaggtatctcgtttgttttttccttgtgggtggctgtccatacgggcggtaatatctcccggtcgttcagccatacgcggcttcctttatagtcccattttccctgtggcggggcgaggtccatttccgagcgtccataattctggaattcgatccaggcaccgacctcctgatctttgggtgaatagacccaggtccaggcataagcggtatgattttcctgtggatcattgtagaagcctggaatggtgtttccccatacgtgacgtaaatagataccggctccgaaggtttcgcctgttccgtaggttttcccgttgtaggtataactgtctttcagctctgtttccggtggaaatactttgttcaggtcgccgttattagggaatgcgtcggtgatgcgccattttacgtttgtctgttttacgtatgagaacggatagcctttgaagttatgctccttatgccatagcatccgtttctcgaattcagcaaaggatttatatgcctgactgtcttccgacggtaggttcgttccctctttgtcgaagtattcataacctcccccacgccatgaacggtcggctattgccagcatgttcggataaaggaaattttcgttgatgatcttttcttccggttctacccagcggtcgttccagatagccatgatgacaccggccatatcgtcgcttccttcggtatggtgatagatggtgctattatataaagcacggatgtcggcaaagatatcgaagtggttcaggtaatggaaacgggagtcgatggctggtattcccggttgtgcttttccccggtaactccacatttgttccatatcgatctctcccggctgatactgccatcccgggttccatgagattacttttttgccttttgaccgtatgaaggccaccatttcaggtacgaattgaggattggtgaacttcacttcatccgttccgatatgcaggtacggcacattgaatgtttcgcatacctcttcgaccaggagcttcaggattttcatcccttccggactctgcatgtcgtggcggaaggtgctgatgaaggcggcactgtgtcccggcatatcgaactcagggatcagtaatacctgatgctgtttacagaattcaaccagttccctggcttcttcttgtgtgtaatacttacccggcatacgggtcgtattgatactgtcgttaagcatcgggaagattttgctttccagtcgccaagactggttttccgtgaggtgccaatggaatacgttgatcttgtattgtgccagtttggctatttcccgcttcagttcctccatcgaagtataggtacgtcccacatcctgcataaatccgcggatacggaaagccggccagtctgtaattttacatcctgtgatatatgctctgtcacctttcttttctgtcagttggcggagggtctgaatggcccggtaaacaccttgttcggtggttgcttcaatcgtgattccttgtggtgaaacctctaatttgtatgcttcattctcatttatttttgcttccggcaggctttcgacaagcattacccggaaaatctttttactggcaggatttacttttatattgctttcctgcagccagtcggtgaccatttgctcggtattacctgccagtgagagagaaatatctttaccggagaacgtctgcttcgtccagtccaccagttgtggccagggaagtaagttctgactaccggtagcatacaccaccggcagccataaacatagtataagtgttatgaacagtttttgcttcatccggatttacttaataaggtcagtgatcttgatcgcctggaaagtcatgtgtgcaacactcgactcatagaagattccgactgtttccttatcaatcatcgacaggcaggaataaccccatccttcagcttcgtccagcaatacctgatgctctgccggccaggtcaggccgccgtcgagactggctttgattgtaatatggttacgtccttttgttgtgttcgggttggagaacaataatagtttcttaccggtgatattgtctttagcatccactttgatgaggctggccatacataccggttcctgaagtgcactgcgactggatggatgttccgtccatgttttacccaggtctttggtgatggctactgcacggctaccgccacggttgtcgcgcatgttcagcattaatacccccggttctacttctgctacctgtgcttcggtagtattggtacgtgccaggttgtgcagatgccatgttttaccacggtctttgctgtacatcacgcctgcgttcggaacgcgtgttgcatcgatgaattggataggaaataccaaggttccgtcctgcatcgtgataccacgtcccggaccctgcaacaggaaataccaggaaggatcttttacctgtgaggtgatgttgatcggttcactccatgttttaccgtcgtcttcgcttttcacaagtactaactgagccgtttcatcgggagtcatacccggcatcgagttccaccaggcacggccgttacccattccgtgtgtccaggcagcaacgatccagacggtatttgttttttcatctaccaggatggaagggtcgcctactccgttctgtgcatgcggcagaccgccggtttcaccgaaggtcatggctacccgcatcggttcccaggtttgtcctttgtcggtactgcgactcacacctatatcgaccatttcctgcaggtcgacgctactgttatagcggatgtcgtatacacccagcagtgtaccgttattcgttgtaaccattcccggaatacggaaagctgcagagccgtcgtcaccggcctggcgtactcctacgccgacacggcggggagcatttgcttttcctttccattcaataagggcgggtttgttattgatggtagcttccggcatagtgaatgacactctcgacaaaagggatgtctccggtttcatttcgatgctgacccagtaatagttttccccttttaccatcggttgtgccgacttcagtgtgatgctattggatggtgttgtaatttcgtcctgtttaactgaataagacagatttgccgtacgggttttacccggtgtaaagctattgacataagctaccggactgaaatgggaaccttctctggcgggagcttccgtaccgctgtaatataatcggatggctttgatatccgacaggttcgtttcgtttccgaactgtaaggtgagtttatttaatacatcccctttctgtgcgggaatacgcatttccaacaggacattgtccgtacggtcgatcagaataggaatctgctgttcccttacgtacaagctgtctgctgcaaaggcggtttgtgcgatgaatagaagacagagataaaagatgttttttttcatgataaatgttctatatgtgttgtttgttaaaatactgaaccaaatctatgcataatctatgtaaaatctaggtattctatgcgaaatctaggtaaaatctatgcataatctaggtaattaatctgtcatattcgccaccttcggtcgaaggaaacaaatctgaataatcagggcgatggcaacaagtcctgccagcatcgcgaaatcgtgtccgaggttacccgcatctgtcgacctgcctaaaatatctgtgatggctgctcctgcgaatacgcctgtcatgttcatgataccgtaagccgtagcacggtaacgcggtgaaatgaactggcaaaggatcggcatattgtttgcatcgaagataccgaaaccgataccgaaacaaagacctccgccgactatcatcagaaagttatgcccgaaaccgagtaataatagcgatggaatggtcaatgccaacccgatggctcccgtgtaaacacggcctcgaacatttgtctgtatccatttgtctgataagataccgcctgcaattactccgataaaagaggataaggcaattgtaatggttgaaagcggtccggcttcagacatatcgatcgacaggttttcggagaataaggtcggtagccagttctttgtcgcccatcccggtaagctcggtgttgcgaaatagagcaggataatccagaaggaaatgtttgtaaacagcattcccatacctttgagggctcctttaaccggattttctaccgctgcacctacttcttttatcttttgaacgatatggtcttttttatctttcagaaacaggatcaggataacactgtacgctattcccacaataccgaaccaatgaaaggtcgtctcccaggtaaaggcacttgccaccgttgcaccgaaaccacctagagcctgtccggtataaagaccggtcatgtggatacctacggccagtgaacgggtttttccctggtgataatcggtaataagcgatagtccggcagggatatataaagcctcgcttacccccatcagggcacgtaggaaatagatctggttgaaagtggtacaatagcccatcatcaacgtaacgaacgaccagacgaacaaacttccgacgatcagccatttgcggtttaccctgtcggcaatcatacctgctacaggactcatgaatccgtaaatccagaggaatacggccatcaggcggccgaaattagccgccgactccagttcggtgatgtcgatcatcatcgcatctttcatggttgagagcatttggcggtccatgtagtttagtaaagctacgccccacaacagaccgacaactacccagggatagatttttttgttattcatttcgttctatatttataaggtgaaaacaaagtttggaaggtaagccatctgaagttcatttgcctgctttagctgacggcaaatgaacttttgacagcattttctttctgttaatattattttgacagaatttctttgcaaagcagattacatttcagaagcatccgggggatgtggaacggtcctttatacatattgcccttagcacgctgagagagtgttccgtcatagtggaaatagccgtaccactcaccgtattccctgtccgggaagcgggcgtaagtatattcgttgatcattttgtgcatttcgagatacttgctgtcaccggttgcttcatacgcatataatgtggcgataatggcttcgcactggggccaccagaatttcatatcgtgccagtattcctgttgaggcaggttcttgcagtctctgaaataggtaatgccgccgtaggttttatcccatccccattcccaggcccagtcgaggatagtcagccccatctgtttcagttccggatcccagttcctgtatttggcttcttccagaataaaccaggcagtttcgatggaatggccagggttgattgtgcgtcccgggatcgagtcgatgaattcaccgttcgggccaacggtttccagaatggttttgaactccggtttcataaagtcgcgacggagttcagcgatggactcgtctatctgtttcgtaaggatttcatcgttgatcgcttcgcggatacgggctgccgtatcgatcaggatcatacaaatggaatgtcctttggcaacaaagccttcacggaatttgggttccagtaatcccggtgtgtttttataataaagaacttgcttgaacagttcgactgctttctctgcataactcttatcacccgaagcgatcgcgtattgagccatggcaatagcagcaaatgtttcggagaatacatatcttcttttacgtaccgggacaccggttgccgttacttcataaaacatacgtccgtctgtgtcaaaacagtatttctcaatgaagtcaataccgtttttacaagcctgtaaccattcttcccgtttttctatgttgttgtaagcgtacgccagtacaaaggcgaatcgtccctggaaccaaaccgatttgtttgaatccatcaaggagccgtctctgtccagacaggtgaaatatccgccgttttccttatcgatgccatatttcaaccagaaaggtatgatatcgttcacgaaatcgtttttgtagacgttgccccagtagccgagatagtcggctggccgggatatatttgtctttgcgtccatattatattagaatttgttacatctttcgaagaagttgattgcttccagttctgctttcattgtagcttcttccgcatctgtcatattctggaacggagtacggtttttaccaagatccagaccgatcagtttcatgatgcgcttaccccctacaatatttccacggaaatggcagatcacgttgatgacttcctgcgagaagttttgtttttcgcgggctgtttccagatctccagcttcccatgcttcgataatgcctaccaattcttttccattgtagttggtagttcctccgataccgccctgggctccacccatagccagacatggcagaattgtttcgtcctgtccgtgaagcatgtcgaatttaccgtctttatataatctgcactgattgtattcgtacaagctttcatacgtatatttaataccggcgaaattaggaatacgtccgtctaccgctttcagaaagtctaccatagaaaggaatgcgccgttgaatgccgggatatgataataatagaaaggcagttccggtgcaccgcaggcaatttcttcgcaatactttaccagttcttccacgcgatttactttagggaaaggggaagccattgcaccgataccccacgctccgatcttctgagcatgagcagccaggttccggcttgtctttacacaggtgcttccgacatgtacgattactttgaatccttccggggcaacttccacccatctttcggccagcttcatgcgctcttcttcatttaacatgtatccttcaccggatgaaccgttaatgaaaacgccttttaacccattgttgactagtagtttagcgtatgcttcgatgggttcgtagttcacttctccattttcataaaacggagtaaaaggggcatcgatcagacctttaattctttccatggtgtatagtatttattgtttatgtatatgcttccgtttagaaacttgacaaaaataaataaaatattttattaacggggttattatttgagaaatattttcctaataaattgaattctctcttagagttactagatgtgttataatatattagggattgtgtaggcggggaaatatgaattccaaagaaggaaagtgaatgtgtatagagtaatccttctttggaattcaaaattgtttggaaatttatttagctcctgccactttgtaacccggagtctggttcaaggccgggttgttggtcagtgttgttttatctatcggccacagcagcttgtcggtatttccgttttcggctaatgtatatttaaatacatattcattaccgaaacggcgcaaatcataccagcgtttaccttccatgataaattctttgaaacgttcttctaaaatggcttcgtttatgtctttatcaatgtcctgattcggataaccgattgttttgttatcgtagttctcgccataagcccgttgacgtatcttatttatttcttccgccggattttctcccagcatagcttttgcctctgccagcataagcaggaggtctgcataacggtatataggataatcgtcgcacaaagagcggctgtcacctgcatcctgaactccctgatatttataattaaagacacctacaagatcaagcgtaccatcttccagcttattgtaagcacctttcagtgtcgccaatttgcggctgtccttgtcatcataccggtatatattctcttttttaatacccaaacggatcagacctaatctgttttcttttgtcaggtcgaacttttctccggtagcagcatcatagtaggtagataagtagtttctctggggaagaaagcttccgccaaacgagccattccataaatcatgttctttgagttggttacggaaagcaaagatgatttcttgatttcctttttcggtgtaggcaaaaacgtcactgaatttatccattaaactcaacgatgatacattattttgtatatctgtcagggcatttttggcaatggttgcgtcttcgtttccgcctcccatttgtttaccggaccaaagatacacttcacctttcagcattaatgtcgcagcttttgaccacatgcttttttgtcctttgatggtataatcggaaccaaaagcatttacagaagcttctatatcagattttatttgtttcattacatctgttgcaggagaagcctcttttgccatattggaaacatctactgtaaatgtcggttcagttgtgatgactgcgtctccccatgaacgtaaaatgtggaaatagtagaaagcccgtatgccataagcttgcccgaggtaatagtttttctgttcttcagtcaatatttcagtttcatcagtacggaggatcatcagatttaactgattgatgttctcgtagaattttccgtaattggaaatacccggattttcttcgtttaaggtattataagggaagcgttccataccctgtgatgcttcacctccgaatggtaaatcaccgaaaacatcgcttcgtgcctctcctaaaaggaagaaattataggcatgatctctgaaacgagtgtgtaatcctgtcatgaaagcgtcgaactggtctgccgatttccagtaattcgcatctgagatggaactgatcggcttcatatccagtgatgtacatcctcctataaagagagatgaaattatggctattgataaaaatatttttttcatattgctttaaatttgaaatgattatcagaaagaaacggaaacgcctaataatacggttcgcggcataggatatctaccttcatctactccggcattatctttcttgattgccggttcgggcgacattcccgtataaccggtaatatagaataagttttgtcctgttatgtagatagaagcatcgctcaatgttgctttttcaatgattttcttaggtaagcgatagcttaatgtgatctctctcaaagccagataatctcctttctcgtagaaacgggaactgttattattgatattgggattcgcattgtttgaacgtgttatgttcttcttaccgagttggtctgcataatagaacttaggcagatccgcattaacgttctcaggcgaccaggtattataaacatcttttattatgttgaaagaaccctgatattgtcccagtgagcgggccgcgaggtcattgtaaataatatggcccagcgcatagtcgaaacgggcaaataaggatatatctttataggaaagatttgtagaaaaacctccggtccatttaggcaaaacatttccgacttttacacggtcatattcgttgataacgccgttattatctaagtctgcccacataacgtctcccggttcgattggttttttaccgatcttttccttatcgctcatctgtgcccatttgttcggaccgtatagttctgcaaccgcgtcatatctgtcaccggcatttgcttttacgtcgtcccaatccttgaagatacgttcctgtttataggcgtatacttcgccgagaggttgtccttcctggtatccgcctacccagatcactttaccggatttagggtcgtatacttccataccgccctggcggttattttcgttaccattgtagggcagcttaatgattttattgtgtaccagcgatgtgttgaaagagaaatcccagctgaacgccttggggtttgaaagaatattaagtttaacttcagcctcgaaacctgtgttgcgtaagcttcccaggtttgttctgatactgctgaaaccggtatatccgggcaactcgaggctggtaagtaagtcgctggtggtacggttgtaataatccaggatcaggttgaagcgattatttatgaagcccaggtcaagaccgacttcaaaagaattactcttttcccagcgcaggtcgctgttgatcagcccggtattcagaaaacctacattgccgttataagggataggaatactggaactgttgttgatggtattatattctccatacacttcataattacccagtccggcaacgttaccattaacaccgtagctgacacgcggtttaacggtggatacatatttggcgatttccgtgtctttaaagaatgattcttcatgtatattccagccggcagaaacgcccggaaagaaaccccagcggttatcacttagcttggatataccatcgtagcgggcaacaacggagaacagatatttatattcatagttgtaattgacgcgggcgaagcctgataacatacggtaaccatctttataagaatagacttccgtcttgtcgctggagccgttcagtgtagggatatcgtcacttggggccttgttcccttttgcctgtagcttgaaacggttgtagtcgaaatattcgccaccgaccattgcttccagattatgcttttctataaacgatttattgtaagtcaatgtggcactatgctgctgttggaactggcgttcatacataccacgtgcattacgtgtattgttgggtgtattactgttttgcgtctgatattgcttatcgaaatcttcttgttcgttatcgatataatagattgaactgttttcattcagtgacagtccgggaataatttcccagcttccaccaatgttgaaagtcgtcctgcggacattgttgatacgttgtaatttatctttccagtaaagagggtttccatctgcagatccgacaccggcagccggatttccatcttcatcgtaagggttgagagtcggccataagctcatggaacgatagaacagctgtgcttcactgatccataaacccggtttttttgaaaaagaataagtagcacctgcattgattttaatattgtcgcgtactttataagatccgttgatatttcctgtaaaacgttcataagacgtacctacgacctggccttgttcattataatatccgaaagaggtcaggaaagtagctttatcatttcctcccgttacactaaggtaatgatcctgggtaaatgaagggtcattgaatgccgcgtccatcatttggcctccgtagtctttgaagatcaattggccttctccgtcgtacgggtctgtcatttgctgccatccctcatttagaagatgtttgttttcttctgtcagataatgaacggagaaatgatctccggcatttgttccatacccggtcgtattgttcacctgttgtaatgttctggtatagccggcatcattaatgtatttgttacctagtcggttataatacaggaaatctctggctccgaggaactcatatcctttgcgggcaaagttcatacctcctttgaatttgtaagagacagtcgctttcccttctttggctcttttagtcgttacaagaataacaccgctgttggcacgagctccgtaaatggcggtggaagctgcgtcttttagaacctggatcgattcgatgtcggcagggtttacgtcattcatggaacgtacaataccatctactacaaccagcgcctgattgtttgcagggtcaccggtaatagttgcaccgccgcgtaagacaatgttgggagcctctcccggtttaccggatgtatttacaacacgtagaccacttactgttccttgtaatgattgtccggcgttggagattgctacgttttcaagagctctgttgtctaacttggaaatggccgtagttaatgtggctctcttttgttgccctccataaccggtaacgacaacttcatccagctgttctgcatcttcacgtaagataacatttactttagtttttccggctaacggaatttcctgagttttgtagccgataaaagagaattgcagagtcgcatttttgttaaatacaataatggagaaattaccatcaaggtcagttactgtaccatttgtggttcctttttccacaatagaggcacccggcacggagaaattagactcatccattaccgttcctgtgatagttatctgctcttgtccccatgcaaaagcgggaagcaacataacaagcactaagatcaggagatttttcttcataataaattacttttatttgttaataaccaaggttgaaactttcagataaattaaagttgatttcgtattttgacagagttcgtgacagactctgttgaaaatggcttaaaaaatataaaaaagaggttgaagttttttttcgccaatattagtttatatgaaatcatatgtggcgggctgaaatattgtgtttttttattttttacaggcttatatttgaaatatatttatttacttttgttcaatcatactataaaatagcaaataataaagccatgaatacaaaatttcttatcactaccgataataaccgtaatgagtcccttaaaaagaaaatcatacattattatatcgccaatggtgatgctacaatagcagaactatgtaaagaaatggatttgagtattccaaccgtaaccaagctgatcggtgaattacaagaggatggttatatattggattttgggaaacaagaaaccagtggtggacgtaaacctaatatttacggactgaatccaacttcgggttattttgtcggagtagatattttccgggataaagtaaatattgcagccgttgattttaagggtgaaaagttaagaatagaagaaaatataccatttgttttagaaaatacacctgctgctcttgaaacattatgtgtccaaatcaatacatttatagactctctaccagtttcgcgtgagaaagtattggctgttggggtaaatatttcagggcgtgtcagaccggagtccggttacagttacagtattttttattttgaggaaaagcctttgtcgcaaatcctggaagaacgtataaagatcaagatctatattgagaatgacactcgtgccatgttgtatggagagtatatgcaaggagttgttaaaggcgaaaagaatattttgtttattaatctgaactgggggttgggactatctatctttattaacggagaattgtattatgggaaatccggcttttcaggagagttcggtcatttttgtttctttgataatgagatactctgtcactgcggaaaaaaaggatgcattgaaacagaagcgtctggatcggctttatatcgtaaattattagaaagatataaagaaggtagtagcacgatccttgcagctaaaatagataaaaaagaaaacataactatggccgatatgattgaagccatacaaaaggaagatgtgctttgtattgaaatactggaagaaatgggattgaatttaggccggggaattgccgggttaatgaatatattcaatccagaactagttgtcttgggaggtgcattgtctctgacgggagaatatatcagccttccgataaagagcgctataaggaaatactctcttaatttagtgagtcaggatactgaaatcagattatcgaaattaggtgagcgggctggagtattgggagcttgcttgttatcaagaagtaaaatattgggaatgatccgatattaatgtctcttttttattcgattttgctaaaactttaatttctcctctctactacttttatatgtatttatatagcccatgagaattaaatatatttttaatcatcatgggctttaatatggaaaaatatatccaatacctgattattattaaattattttatttatatttgcgcaataattaaagagtagtcgctattttgcctgtaataatgaaaagatcaaaaaatatgaaaatgattctcttttatattttggtataccagagtctgtcacgaactctgtcaatttgatatagggactgatttatttacttaaaaatgatttaatagtatatttgttgtattgacccaaaagtaacaatacggaaaaatcaaactcgactaaaaataaattggtagtgttcgttctgatttaaacgattgtgttcgtatatttgccgctatgctaacaaatctgatcgacgaggaactattagtgaaggaactgaccctgggaagccagaaagcttttcaggtattattcatgcgctattaccccaagatccgtggttttgtatacggtttggttaaatcggagcaggatgcagaggatattgcccaggaagttttttctaaagtatggggaaaccgggataagtttgccgatgtgaagaactttggcgcttatctgttcatcttgtctaagaataccactttcaattttttggaagctcaacaaatacgtatcgaaagattaaaagagaaaccatttgaagaagagaccaatgactctccggatgaagatttaattgccaaggatttgcagcttttgatcgatatggtggtagaaagcatgcctccacagcgtaaattgatctatcagttgagccgtgagatcggattatccaaccaggagattgccgaaaaattacaattaagtaagaaaacagttgaaaatcatctgaatttggcgttaaaagaattgagaaaggttttattatatctattgatactttatttgtgttaaaatattgggggcgaaatgcccaaaaagagtctttataatataatgttaaggacagaatgagttatataaaaaaaatagttgattatttctttcatcatgacttctcggaagagacgataaggaaagtacatcaaaggctgacaaagggagatgataggccggaggtagacgatgcgctactgtcggtctgggatactatggggttcccggagatggacgaaaatcattcagaacaggctttttctcaattaagcagacaattaggtttctcagaacaaaaggaacctgtgcggaaatctttacggccgacgtcatttgtgatgaaactggcggctatatggctcttaccgttgatcatgctttcttcttccgtttatttttattggcaggcaaatatagttaaagatgccgtggcggatgtttcgctgattgagcatttcgttccggcaggcaaacgtgaacagatcattctgccggacagtagccgggtttggttgaattccggtagtgtattgatttatccttctacttttataggacagacacgtgatgtttatctgtctggtgaaggttatttcgaggtagagaaaaatgcggaacaaccttttatcgtgaaagcccgcacactgaatgtagaagtattgggtacgcgctttaatattcttgcttatccggaggtaaaacagattgccacgacacttgaagaaggctccgtacgggtatgtctgcaggataatgataagaaagtatatcatctggtgcccgatgaacagttggtatataatatcgactccggaatagtggatataaaacaggtcgtctctgccgattattccgactggcgcgaaggaggtttattatttgacaactactctttttcagatatcatccatattctgcaacgtacatatggagtaaatgtacatttgcagacatctatttataataataacaaaataacggtacattttaataagaatgaatcgttggaaaatatattcatgcttttgaaggagctaatccccggacttgaatatcgtattgataataaagatatctacctgaaatagggaaaaagcatttttttacgatgtaattaaaaaaagtttcagtttcgattgggtgcaacgttttttccatctgtcattatagatgagtacgcacttaaaaatcgtgttattgtttaacttttttaattacatatgaagaataaacacaaatccagacgaattggaacctattgtctgtgcttcctgatcgcaggttgtctgcagatcaatgcacaaaaggtctcctttaatgaaggaacagtttcattaaaggaagcgttccagaagatcgaagcttcatccaagtacaaaattgcttataatggtacgcagttggatgtcagcaaaagggtacaactgaatcaaaagaacgtagaagtattggatgtattaaagcagatcctggctgatacaggttatacttattcgattaaaggagattatgttgtcatttccgtacctgctaaaaatgcagtcgatcagaaagaaaaaaccgtaaaaggagttattgtcgatgaaacgggcttgcctgttatcggtgccaatgtcgttgtttcgggaactacaagcggaaccgttaccgactttgacggaaactttaccttgcaagttcctgaaaacggaacactggaaatctcttatatcggtttcctgacacagcaaatctctttaaaaggaaagaatgatttccgtattaccctgaaagaagatagccaaaaactggatgaagtggtggtggtcggttatggaacccgttcacgtaaaagtattaccggttcggtagaccaggtgaacagcgagattttcgagaatcgtcctgtgaccaatgctactcaggcattacagggagcatcagccaacctggttatccagagcaagaacatgaatcctaatgacaacagtatgaatatcaacatacgtggtgtcagtacgatgggtaataacgatccgctgatcgttatcgacggtttgatatccagttcttctacactgaataatctgaacccgaacgatatcgagaatgtctctatcctgaaagatgccggtagtgcggctatctacggctcacgttcagcaaatggtgttatccttgtcacaaccaagaaaggatctaagggaggtaaaccacaggttacatttaatggacagatcggtatgcaggatccgcgtattttgttctctccggtagaaggttggcagaatgcgatgctgagaaaccaggcaaatgtgaatgtcggtaatgcccctcaattcactccggccgctattcgcgacttatatgaccaccgcgacgaagaagaatggctgtacgatcagatcatccagacaggtcttcagcagaactacaacattaatgtatccggtggtagcgagaatacaacttatatggtatcggccagttattttaatcaggaaagtaactttaagggtaatttcggcatggaacgttataacttccgtacgaacttaagcacggaatacggacgcttcaaactgacttcactgatggcctacaaccgccgtaaggaccgtaccgttgccggcggtactggtaatgcgatcatcaactcttcccgcgtaccttcttattactattataaattcatggaaggcgacaaatatctggtaaacgatattgtaggtgatgacaacccgctggcattgttgcaggatggcggttatgaaaagaaagacgaggataacttcatcggtagcatgaatctcgacttcaagattatggaagggttaaaagccaccggtttgatcggtttggacctcacgcaacatcatcgttatcgccgtgataagaaagtgcctttatattcgtctgccgatctgacaaatccggtattgtatatgcattctaatacaatgacggaagactataatgaaaaacggtatacgctcagttcccagttcctgttgaattatgaccgtacatttaaggaagctcaccatgtaacagccttgttcggtgcttctaacgaatcatatacgaagcaggccagccgtatcgcctgggaatatacggacgaagatctgggtttaccgacaacagacgactccgtacagaataaagaaaataagaactcgaataatgatacagaccaaacgagtatcacatccgtattcggccgtgtaggttatagctatatggataaatactacggagatgtctctttccgttatgacggttcttccaagttcgctaaagatcagcgttggggcttcttcccttcgttctctgccggctggcgtttgtcggaagaagcttttatggatacttataagagcaatatcggcgatttgaaactgcgtgcttcttatggtgtattgggtaaccagaatgtagataattattcctaccagacagtttatttgatagagaacaatcagttcgtatttaataacacatcgattgccggtacgaagattacggatggtaacgccttattaacctgggaaaagtcagccaactttaatatcggtgtggatgctaccttcctgaatggtaatttgtatgtatctgccgattatttcaataaaaaaacgaccaatatcctgttgactcccgaagtatccaccatttatggaggaactactgctaaggaaaatgcgggcgaaatgaaaaaccaaggttgggagttgactgtcaactataagctaaatcatggtgattttcaccataattttaacttcaatatttcagactctaagaataaggtcactgattttggcggtcaggaacgtatcgacggactcgatgagttatacaagctgatccgtgaaggcgaatcgttgggatcttattatggttacaaaaccgacggtttgttccagagctatgaagaaatagctaacagtgcactgcctgtaggtagttccgttcaaccgggagatgttaaatatgtcgatcagaacggagataaggttattaatgagaaagaccgtgtcgtattaggaaatgcatttcctcgttacacattcggttttacttacagtttagcctggaaaggatttgacttgaacctgatgttgcagggtgttggaaaacgttctcagttccttcgcggagagttaatggagccattccatagcaactattcatattgtatctataaacatcaattggacttctggacaccgactaatacggacgcccgctggccgcgcctgacagctcctggctctgcttctgctactaacaattggagcctggctggtgataatcatatattaaatgcggcttatctgcgtgtaaagaatattcaggtcggatatactttgcccaaatcgctgactcagaaatttggtgttcagaaactgcgtgtcagtgtgaatacggaaaacccgttgactttctgtaaaaactcatttatcgatccggaatcatccgaatttggtagtaatatgggaggtaccggtggtatgggcggtaatagcggtcgtaactatccgacgcttacttattacgggttcggtttagatatagaattttaatacatctgtttattatgaaaatgaatttcttaaaatatagtacaggttttgcttgtttagtgctcgcaacctttatatcctgtaatgatctggatttggctccaaccaataaatttacagacttgaactattggacctccgaagcaaaagcctctgccgtgttgagcaaggcctatgggcaaatgatgacgtccgaatatttcttcaaagatgaaaagctatccgataatttatatgaaggtcgtggcagctcggatgaaaaactgattacttctggtcaggcaaatgccgcattaggtcgtttctcggaagactggaaaaaatgttatgaaggcattaaaacctgccatactttccttgaaaatgtggatcgcgttccgaatatggatgagacattgaagaacaggatgaaatcagaagcccgctttatccgtgcttatctgttcttccgtttgaccaaccattacggtgatgttcctttgttcgattatggattgtcaattgaagaggcaaacacaatagcccgttcaccgagaagcgaagtgctcgattttgttcgtacggaactgaacgatattgtaaagatgttgccaactaaacagcaatatacagcagccgataatggccgtataacccagggagctgccatgacgttattggctcgtacctatctgtatgaaagcgactgggagaatgtagcttctgtttgtgagaaaattatcaacggagaatacggcgaatatactttgtttcccagctatgaaggattgttcctgccggaaaatgaatacaacagtgaagtgatcctggatatgggatatttgctgaacctgagaacatgggctgaaatgtacgatgcaattccgctttccgtaggtggacgtatcaatgcatttgcacctacccaggaactggtggacgattacctgatgaagaacggtaaagcgatcaatgaagccggttcaggctataaggaagatgatccttatataaacagagacccccgctttaaagctacgatcgtttatcatggctatcagtggacagacggtaaaggcgtaacctcaactatctacatcaaaccgggttcttctgaggatgccggtgtagctaacctggatgaatatgcaggccctggccaaaactcgacaggtaccggatattatatccgtaaatatttcgaccctaccgctccggaaggaatcgcagcgggcctgaatattatgctgatgcgttatgcagatgttttattgatgtatgctgaagctaaaacagagctgggccagatgaacgaagctgtctggaacaagacgatcaagcctcttcgtgaacgtgccggatttaccgatgcatctgccttgaattatcctgcttcaggtaatatgcagtcgatcgttcgccgtgaacgtcgttgtgaacttgccatcgaaggtttgcggatatatgatatccgtcgttggaaaaccatcgaaaccgtattgaacggccgtcctcatggagctaaattcgctgccgataacacacaatatatcgagctggatgcccgtaagttcagtaaagacagagattacttgttcgctattccgcagtcacagcgggatattaacaagaacctgactcagaatccgggatattaatcaaattataaatctaattactcagaaaaagatatgaaagcaatatctataacatatgcgatgcttttttctttcattctggcttttactgcctgtagcagtgatggagaagtgagagatctgagcgtgaccgcagtaaaaacattatacgaaccggataacggtaaggcagttgttctgcaaccatcagcatcggcttctttatatttcgaatgggaaccctctttagccgaagacggtggagtcgtgctgtatgaagtagtctttgataaggcagatggcgatttctcggatcctgtttatatttctacggcagacaataatggtggtagtaaccatgctacaattacgcataagcaattaaaccagatcgccgctttggccggtatcgagtctgctgcccagggaacattgaaatggacggtatatgcctctaaaggtatcaatcccgtaagggcggaagaggaacgtacgctgacgcttacccgcctggcaggatttgccgaagtgccgggccagttgtatatcaccggtgaagctacggaagtgggagccgatctcgataaggcaatggtgatgaagaaggttgccgacggtgaattcgaagtattcattaaacttaccgaaggcaaatcattcaagttcgtcagtgccaacaccggtactccgaccgaatattcattgaacggcgagaagctggttgaaggaggtagtgttacggctgctaagactggtatctataaatattatatcgatttcaatgccggttcgtttacatcgaaagaggtaaccaaagtgaaattctatctgaactggtcgcagaaagagatcgaactcgattaccagggacttggagtctgggcattgaacggttacacgattacaggtttgacagatagtgataatacagacgaccgatataagttcagaatggaaagctccgacggagagaccgaatggagagctgccatcaataacgacagcaagccgaccggaaatgatgagtattattatatggtggaaaagacgaatgtagaacagtggacgaacaatgaagtttggaaaaccccggctactgatggttggagcgataaaacatacgatattacattctctttgaatacgcaaggtgaatatactcataatttagtaatcaaataaaaaggaagaattatgaaagcgatattaaaaaaactgatgtttatcagctctgttgcgctggtattcatgggatgtaatgataatatgggagacactgacggccgtctggcaagtgtgaatacattgctcgaacctgcggatggcaaatcggttgtactggaggcttctgcatcggcaagtgtctattttgaatggaaagcagccagcgtggaagaagctggtacggctctttatcagattgcttttgataaagcggacggtgacttttcaaaacctgtttatgtggtgtctgctaataacaacgggtacaacaattttgctaccgttactcataaactgttgaaccagattgccggtaaagtaggtattaaacctgccgatacaggtactttcaaatggaccgtattctctactaaaggaatgcaaagcatgaaatcgagtgtgaaaaacaagatcacagttacccgtctagccggatttgaagatgttcctatcgatgtatatgtaaccggtgaagcatccgaaggcggtgcagatctggcaaaggcacataaaatgaaagcggtagcaggtggcgaatttgaagtatatacaaagttggcagccggtaaatcattcaactttactgacggcaaatctggaacgacgagagtattctatacagccgacggcgttattaaagaaaatggaacgacaacagtacctaaggacggtgtctaccggattacattagactttaacaccggtgcttgtacctatacattggtaaataagatcggtttctatttctgtccgaatgatgaaatcctgtttgaactgccttacgtcggttatggcgtattccagacaaaggcaaccgtgaacttcaaggaagaaagctggggtaaagacgaacgttataagttcagaatgtttatccaggaaaataatggtgccgatgcagagaaagaagtcgactggggaacattgaaccagaccgactcacgtccgacggcatccagcccggaaacgtattactacctgcaaatgtttaacgagacttctcagtgggaaaataaatggaagctgatgggagattttgatggtgttccggcaacttacactatttatctgacggctgatcagccttatacacatacgatagttaaataatccagagtaaagataataacatgaagaatattctccttttcttatttctcccccttttgttttgggcatgtggcgacgacaacaataatccggtgaatccggatgaaggtgaaggcatcgactggtatgccgccgccgatagcagtaccacagcattggtcaactctttctggaataccggagggaagtattttaattatgacagtaacgggaatgagactttccattactggccccaggcccatgcattggatgtgttggtagatgccagcctgcgtaccggggatatgaagtacaagacctatttcgatcaatggtttgaaggtgtaaaggtaaagaacggtaacactttcaggaatgatttttatgatgatatggagtggaatgcactggctatccttcgtgcctatcaggtcactaaagaccggaagtacaaagaagcagccttgcagatctgggagtatatcaaagtcggctggaatacgaatgccggcggaggcatcacttgggtgaaagggcaggagtacagtaaaaacgcctgttctaacggtccggcttgtatcctggcagcccgcctgtttcaggaattcggaaatgaagccgacaaggagtgggcactcaagatctataactgggagaaaagtaccttgttcaacagcaataacgggatggtgtatgataatataaacagcaataccggagagatacagaaagattggatatttacttacaatgaaggtacattcatcggttcggcagtagagttgtataagatattgggagaaaaaagctatctgaacgatgccgtcttagcagccgattatacaatcagtacattagtaaataattctcttctgaaagacgaaggaaatggagacggaggattgtttaaaggaatttttattcgttattttacggagttgatccaacaggatcgtctggatgttggggctaaacggcgttatacgcaatttttgaatgtaaatgcagaagcgctttggacgcgggggacaaataaatcgaatgttttattcggcacctattgggggacagccccgggagcgtctaccgggttgaccgagcagttaagcggctgtatgctgatcgaagcagcagcattattagaagatttggatctgttataagtgtttttagttttgtctctaataataaataacatgaaaaactattttttagcgggtttcctgtcattagcttttatggtaagttgccagcccgataaacgactgacaaattatgtgaatcctttcctggggacggcaaccctttgggaaacgaaagatttagggtacgaacgtcacctgaagacgagaacctggggagcggaagtctttcccggctcttccgtcccgaatgcgatgattcagctaagtcccgttacccagttccgtagcggggccggttaccagtatgaagataccgttatctatggcttctcgcataccaataaggggcattggaacctgttgcatcttccgattttgccggtgacgggcgatatatcttccgacgactatgcttcaaaatacagccataccaacgaatcggcccgccccggatattatcaggtgttcctggaaagatatggagtcaatgccgagctgacctctacgctccgctcggcttatcataaatatactttccgtccggaagacgataagaaagtattggtcgatatcacacgtacgaacaacggtgtgagagactggagcattcggaaagtggacgattataccttctccggtaatcaggatgcggaaggaaatattcgtttctatgcggtttctaactataagatcgatgatatagaacaggtaaagagcggtgaacacgaagtttcggttgtcaactttgccgacagcaaagggaacaagcccctggaactaaagatcggtttctctttcgtaagcgtcgataatgcaaagatgaacctggagaaggagatgatggataaaagctttgcacaggttagcggagaggctgacaagacttgggaaaagctgttgtctaatatagaagtgacaggcggtacggagcgtgagaagggtattttttattcctgcctttatcgttctttcctctggccggtgttgcgtagcgacgtgaacggggaatatacggatgtgaagggtgatgtggtaaataatggtttccgttattataccgatccgtctttctgggatgattaccgcaataaactgatcttattgggaatgatctctccggatgtaacggtagatgtgatcaaatcgattaccgataaaggggaaaagcgtggtggctatatgccgaccttcttccacggcgaccatgcttctgcttttgtagccggcaactatctgcgcggattgaaagactttgatctgaaccgtgcctataaattgttggtgaataatgcaactatcccgggaaaaggtggccggccgtatctggacgaatacatcgcacaaggctggattgcagaaaaagataccaccaatgtcccgacctgggatgaatacaaagcagcggtaacgaaaaccgtcgagtatgcatacgacgattatgcaaccgcgttgttagccaaagaactgggcgacgaaagtacttataatactttgatggagcgtaccggcaactataagaacctgtttgatccgagtaccggtttctggcgtggaaagatagccgatggtagctggatcaaagatttcgatccttactatccttattatgcctatatgtatcgggaagcgaatgcctggcaatctttgttcttcgctccccatgatccggaaggaatgattgctctttatcccagtaaaaaggccgttgagcagaagctcgactcactctttaccgagccttggagaaactatgaagcccacaatttgaccggtttcatcggtaattattgccagggtaaccagcccggacatagtattccttatacttattactttattgataagcaggaaaaggcacagtgtatgctggatagtatcatgaatcattattatgatatgggtaaggacaaactggcctattcaggaatggatgatgccggtgagatgtcttcctggtatgtcttcaacgcaattggtttatacacctattcgccggcagatccggaatatatcgtaaccgttcctttgttcgaccaggtgaaatttacgctgggcgataaaacccggttcacaattgttaaaaagggtaacggccaaaagataacggacatctcttacgacggccggaagatcgatggttggtttatctcgcacgatttattgaagcagggaaaacagttgacgatcactaccgaataaaacctgctttccttttatagaaaagctgccgtcctttttacgaaaagcccggcagctttttattaagctctactgtctagtcctaaaatatcgttacacctaacaaagtaacgaaatggaaaagttagaaagcaagtacgttagacgtacacaaaaggattacagcatgtcctttaaattatcagtagttcacgaatatgaaacaaatcggttaagtttggccaaacttaaccgatttgtttcatattcgtgaactactgataatttaaaggacatgctgtaatccttttgtgtacgtctaacgtacttgctttctaacttttccatttcgttactttgttaggtgtaacgatattttaggactagacaatactctgaacgaaagggagacgtagctttgcaacgtctctttttttatatctttgcatcgcaacttaaaacttacaattatgcaattatcaatagaccagaaagacgtagataaattcatcatgataggcgacaaggtgcttatcaaacccaagaacccgcagagccagacaaagtcgggcctttacctgccccctacggtgcagcaggaaaagatacaaagcggatatatcatcaaggttggccccggcttcccgctcccatcccagagtgaagaacacgaagtatgggaaaagaagaaagaaggagaggtgcattacctgcctttgcaggcacatgaaggcgatctggctgtgttcctgcaaaatgccgcttacgagatcagctttaacgacgagaagttcctgatcgtgccgcattctgctatcctgatgctgctgcgcgacgaaggattgttcgaataaggcctttttctttggcaaaatacttatctattcacatatttgatgtatttttgcaagcaaatcaacaagacaaactatcaacagtagcgattagaatgaataaaattgtaagtaaagaacatttctctgccaacgtggtgaagctggaagttgaggctcctctgattgcccgctcacgtaaggccggtcactttgtgatcgtgaaagtgggagagaaaggcgaacgcatccctttaaccattgcaggggcagacactcagaaaggaaccatcaccctggtgatccaggccgtaggcggttcatccaagaagatctgcgatttgaacgtaggcgattatattaccgacctggtaggtccgctgggacaagctacccacatcgaaaaagtaggtacggttgtttgtgccgggggaggcgtaggtgtagcaccgctgttacctatcgttgaagcattccataaggccggaaaccgtgtgatcgtggtactggcagcccgtaccaaagacctggtgatcctggaagaccagatgaaggccaactccgacgaagtgatcgtgatgaccgacgacggttcctacggtaccaaaggattggtgacgaacggtgtggaaagcgtgatcaaccgtgagaaggtagacctgtgtgtaaccatcggtccggctatcatgatgaaattcgtttcggcacttacaaagaaatacgagatacctaccgtcgcttccctgaacacaatcatggtagacggaacaggtatgtgcggcgcttgccgtatcacggtgggtggaaagaccaagttcgtctgtgtggacggaccggagttcgatgctcatcaggttgatttcgacgagatgcttatgcgtctgggtgcttataaagatattgaaaagaaataaccacttaaacaaatgacaacagcagaactgattgcagcccgtcgttccgaaccctggagggaagaactgcgcaagagcaaaaaaaataaagaacgcacggatattccccgtgtagaaatgaatgaactcgatccggaataccggagccatacccgcctggaagaggtgaacctgggtctgacaaaggaacaggccatgcaggaggcacaacgttgcctcgactgcccgaatccgacctgtatggaaggttgtccggtaagtatcaatatcccgacattcatcaagaacatcgagcgcggcgagttcctggaagcagccaaagtgcttaaggaaaccagtgccctgccggctgtttgtggtcgtgtttgtccgcaggagaaacagtgcgaaagcaaatgtattcatctgaagatgaaaaaggctccggtagccatcggttacctcgaacgtttcgctgccgactacgaacgggagagcggccagatctcagtgcctgagattgcagaaaagaacggaatcaagatcgccgtgatcggttccggtcctgccggcctttcttttgccggagatatggcgaagcgaggatatgatgttaccgtgttcgaagcattgcacgagatcggtggtgtattgaaatacggtattcctgaattccgtctgcctaataagattgtggatgtggagatcgaaggccttcgcaagatgggcgtgaagttcatatccaactgcatcgtcggtaagacgatcagttacgacgacctgcacgaagaaggcttcaaaggtttctttgccgccagtggtgccggcctgcctaatttcatgaacataccgggtgagaacctgatcggcatcatgtcgtccaacgaatacctgacacgtgtcaacctgatggacgcagccaatcccgagagcgatacccctgtattgcaaggcaagcgggtagccgtgatcggtggaggtaatactgcgatggactcagtccgtacggcccgccgtttgggagctgaacgtgccatgatcgtttaccgtcgtagcgaagaagaaatgcctgcccgtatcgaggaggtgaagcatgccaaagaagaaggcgtggaattcctgaccctgcataacccgatcgaatatatcggcgatgaaagaggccgtgttaaacagatgcgtttgcagaagatggaactgggtgaaccggatgcttctggccgccgccgtccagtagccatagaaggcgccatcgatacgatcgatgtggacgaagttatcgtcagtgtcggtgtttctcccaacccgcttatcccgcgtgccttcagtggcctggaagtaagcaaatggggtacgatcgtagtcgatcaggacactatgcgctcagcactgctggatgtatatgccggaggcgacatcgtaagaggtggtgccaccgttattctggcgatgggtgatggccgtaaagctgccgccgccatggacgccagcctgcaaggaaaatgatctgaaattaagatacagtgagaagcccggccggtgaggtcgggcttttttattcctgctaaagagtgaaactcttatagttccctaattttaagcgcttcccagcaaaaaaagattgtaatgataaatttattattatatttgcgtttaccgtaaatacggtaccagacataaagagaggtaaagaaggtatttatacaatagttataaatattggtgtgtctatgaaagggctgcggcagcaatgttgcagccctatttctttattgatgcttgagtatgtctaaaacatctttctttaaagccggaatgtgtctaatgatgagtccccagagaaattcggtggtgacactgtcgtagccgtgtattactttgtttctggtattgacgatcgctctggcattaggcaatataaaagtcggatctattttgagaattcgattgatcgcttctcacattatctcaacattccgctcaacggctctttggagaatgatcttattcctgaattcctcgaatagtttaggcccttcagaaaaataactttccacttcattgatagaaagaagcacatcatacagatgtttttcaatgtactcatccatagattaattgctttgatgagtcaatgttttttcgtaaaataggatttcgtatagctttatcttccagtaagtctacttccctacggaggatattggataatgcatctcttaaatcaaagtaattgtctgcataatcttccggtgtgacgccttcaaagtcgactaataaatctatatcgctcttatccgtaaagcggtgggtgagaacagaaccgaaagcaaacaactttttcaccttatgcttttggcataaagcaatgattccgggtaagtaattgctgaagaagttcatatcctttgtttttagttataacaaaggtatatattattctttaaacggacaatagaggatcgttgtataaataaaaagccccgatattgcaagcaataccgaggccttttggaagcgagcgaaagacgggactcgaacccgcgaccctaaccttggcaaggttatgctctaccaactgagctactttcgcaaatcgaaagggatgaacccgaaaaatacatcctttgtactcgaagcgggacttgaacccgcacagccgcaatggccaaaggattttaagtccttcgtgtctaccattccaccattcgagcatccctttctcttaagagatgagcgaaagacgggattcgaacccgcgaccctaaccttggcaaggttatgctctaccaactgagctactttcgcgttgtttgcgtttgcgtgtgcaaaggtagataacttttttatatctgcaaataatcgggtaaaaaaattagctttaagtgccgatttttttaatattggatcaataactcactccctctctgagtgacattaaacctcgtaagtgcaaattctgacgggccatctgacggagttccagagccatacgctatttcgtacttcgttccgcattccggacattgtgcccgacctgtattgtccgcttttactttaatattcttctgggcttcgtgagggcagcacaaatcataagcataatattgtgtacctcccgtagtggcactgaaaccgtttacgaccaacacgcccgaataaccgagccgtgtaccgtaattctggcctgcctcgcttgtgatctctttgaagttaagggaaccaaccaggtccttgtccttaaactgcaagtccaattccaggtacaccggtgcataaggtacgttcgatacattcaccttattgcacgacatcaccagcaacaccaccaaacaaaaaaatattcttttcatcttaattatgctaacagtttcttttcagcttcgtttaccttattaaacgagaaaccgtcgataatattttgcatcagggcggaaatactgtcgttgcacagattgccgatgctaccttcgtgtgtatggttcacggccttgttgggcgtgaagttacccgcttcgatctccaggcctacttgtttgtaagcgtcgcggaaaggaactccttccaggacgaggcggtttacctcttccacgctgaacagcagggaatatttatcgtcgtcgagaatatgctcgttcaccttcacttcgcgcatcatatgggtaaccatacgaaggcaatccttcagttcgtcgaaagcaggcaggaacacctccttgatgatctgcaggtcgcggaaataccccgacggcaggttattgcatatcagtgtgatctgctgtggcagaccttgtatcttattgcatttcgcacgcgtcagctcgaacacgtccggattcttcttgtgcggcatgatgctcgaacctgtcgtgaactggtccggcaacttgacgaacccgaagttctggctgttgaacatacaagcatcgaacgccagcttcgaaagcgttgcggcaatacccgccatcgcaaaagccaccgtacgttccatcttgccacgtcccatctgggcatataccacgttgtagtccatcgagtcgaagcccaatagcccggtcgtcatgctacggttcaaggggaaagacgagccgtatccggcagccgaacccagcggattgcggttgcacaccttgtaagccgcctgcatcatctgcaaatcgtcagccaggctctcggcatacgcaccgaaccaaagaccgaacgatgaaggcatcgccacctgcaaatgcgtatatcccggcatcaacacctcgctataacggttgctctggcttatcagtacctcgaacaggccgtttgtcagttccaccaactcctgtatctgtgcgcgcgtgtacagtttcaggtcgagcaatacctggtcgttgcgcgaacgtccgctgtgtatcttcttgccaatgtcgcccagacggcgtgtcagcatcagttccacctgcgaatgaacgtcttccacgccttcttcgataacgaattcgccgctgtcggcaacggcatagatatttttcagctctgccagcagaaccgtcagttcctctttcgtgagcagcccgatactttccagcatcgtgatatgggccatcgagccaagaacgtcatacttggccaggtaaagatccatttcacggtcccggcctacggtaaaggtttcgacttccttgtctacctgtacatttttttcccaaagtttctgagccataatacggagattaatagggcagggcggcaatcacagttgatattttgtcgagtgcgtcctgcaacggtttcgataccatcggtttgataaacgggttcagatcggcgcggatcgtcattttcaaccgcgtgtcgttctcttccacctgtttcagttggatccagaggaaaaggggaacgggcgagttggttgtagtaaatttgattgttttgttcggttcgcgttcaacgatctcgaaacgtatcttacctacgggatcgacagcgaaactgcaagagtcgctgtcgaactcaaagtctttaattttatcctgtggaatgcggtccttaacccgttccaggttggaaaggtcggacagcattgcatagacacgatcctcgttgtgagggatcgttttgatctcacttacaaattctgtcatcctgtactcgtcgtgattaagcttcagggttccagtttgcagggtctttacgccattcctgcagcgtagcgatttccgattcgtcgatatagtctgtacgtacagcttcttcgataacggcatcgtaattgctcagtgtagtcagcgttactttagcatccttgaattgctgtgcagctacagggaaaccgtgtgtgaagatggcaaccatacctactacgtcgcaaccgaagttacgtacagcctgtacagctttcaagctgctaccgccggtagataccaggtcttcgatgatgactactttcgatcccggtttcaattcaccttcgataaggttttccagtccgtgatccttcggtgttgcgcggatgtaaacaaaaggcagtcccaataaatcggcaaccagcgcaccctgtgcgatagctcctgtggcaactcctgcgatggcgtctgcgttttcgtatttttcgctgatcacacgtgccagttccagtttgatgaaactacgaacagccggataagaaagcgtttttctgttatcacagtaaatcggcgacttccagccggaagcccatgtgaacggattggccggttgtaacttaacggctttaatttttaataatttctctgcaactaatctttccagtgttttcatacaatcctacataatatatttatatcaaagtgcaaaagtagctaaacagaatgatataaccttgtagataccgaaaaaaatgaagtcctgaaaagatgttattgaaaacaaatggcctccccggctaaaggaggccatttgttaaagaagtttcagccgtatcctaagggataggcgcaaatacagggttatccctttccgtgccaggcggagcagcagggccgggatatgtttcaacagcggcaattgtttcatcatccggtgtagttttaaagtgaaacaaaaagttcagcaatgcaagaatgaattcgatgattcgtttgaatttggacatggggtcgattgtttgttggttgttattaattatgagcatctcggttattatcaaatgtgaatgtttcattatttgacagatgtgaatgttgtgtcggccgtaggggcggggtctgcccgcccttcttcaccggttgttatattattgtcgcaaagggcgggcaaaccccgcccctacaaaacctgtcatttggtttcacattttgctacatccgatcgcgaagcccaattattcattattaattgaaaaaggtttcacctttttctaacctcccgtcaacgccacgatagcctgtaccgtcctctctatctggacgaggctgcggcggtaggattcgcggtcgtcaccgttcaactcgctgatgtaggggctgtaggctatttctcgggcataggcttccgggtcgttgctgcactgccaggccacgcggtagctattccggatcaggcgggcgaagtcgaggaaagagtttgcgcgggtgtcgtagcggcggaagtggagcgaataactatcggttctcacctccgttttcccaccgtgccagtactcgttgctgcaaccgtaagctgtcaggccgaagaaattattactctccgttgccagccggctcgtaccccatccgctttcgaaagcagcctgtgccagtatcacggaagggttcatgtggaaaactgcgcctgcagacacggcggcctgcagggagtctttgacgaatctgatttgttgtgctgtcataatgctctgattttcaattttcaattactcgatgaccggtcggtcgtcttccccactgccaccgccttgtgacggttctgtttccttgccgatgcgttcgaggctgatcttttccagcatggcacgcagccgggcgccgggggtaaagatgatcttcggcttgcggatcatatttgcctggaaatccttttcggttagcgagccggaacttcccagcgacaggcggaaacgtcccagtgtatccagttccactacttcgttacgcaacaacgcctcttccgttgcacgcagcaggccgcgcaccaccagtgccacatcgccgtcgctcgctgtcgaacggtcggctatcacatcgcagatcgaattaaaattcatcgttccgcttaccggggcggaggcataataccgcttggcatctgcggccgctcctttcgtaaggtcttttttcaagaccagtttgtactttactgacataactttaaatgattaagggttagtgtattaaaatctatctcttgactacattacaaagatactacaccctttgccgatgatgggatgctatgagaaggtgtggaataatcagtatgtattattttttcgataaatatctgcggaaaacctaacaacgtatcgatttaattcttatattgtggtattgtaattatttaaatatcagaaaaatatggaagataaaaaaacggaattatctccctggaggagagcgtatggggtaacggaattcgcccagctgtattttcccggccggacaccggtgattgcctataaacgtatgtgggaatggatacgcacttcgcgcggactgaaggccaaattggaagccgccgggtgggtgaagttccagaaactctacacgccgaagcaagtcggcgtattgatcgaacatttgggagaaccctgatagtattaaatttaattgacttagtatgaggaattcagtgaatcaaactgtcgaatgtaccctgttcagaacagcattcgacaccacctcttacacgccggtcacccttggtggttatttcgacgacgtggtaagcggaaagtacaagagatcggtagaaaacgttcgcgccctggtagccgccggcaatcaggaaggagcgaaggcatgtaaaaagaacctgtctctgttggtggcaggcggacggatggaaggcggccgcaaacgtgagcacctggtagactactccggctgcgtggtgggcgacctcgaccatgtgtccggatcaccctcggaactgcttggccgcgccaaagaactaccgtatgtgaaagccggccatatcagcccatcgggtaccggtcttaagctcttcgtgctggtagacagcgaccttgaacaccatgcccaggccttcgatgtagtgagccgcctgctcgaagccgacctgccgggcgtgaaggtagacccttcgggcaaagaccccaaccgcggttgtttcgtaagctacgacccgtcggccttttataaggaagcatccgaagtggtgaatgttcccattggccccgacaaggccgatgtcttctctgaggcggaaccccgttcgctggccaactacatcgacaagtttgaaaccggcaaccccttctccgacggtggccgccacagctacgtggtgaaactggcctcggctctcaacagtgccggcttcggcgaaagcgaagtagtggccgaatgcctctaccgctacgccgctcccggctttagtgaaaaagagatcctggccaccgtgtccgacatttaccgccgttaccgttccgcgcatggcagcaatccttaccggcagtcgatagggcaggcgacgaaaaaaagtatcaaaagtatcaaaaatctcacccccattcccgaaacgggactttccgacgaagggtctaccctggggcctgattttgaaccgggagaaagcgattttccgcacttcggaaaaagccttttggccggcctcccgaacctccttgcggacacattgaagccggccgtcgacgatacggaacacgacctgatgttgctcgccgcactcaccatgaccagcaccgcactgccgggcgtgacaggcctgctccgtaaagaagtatgttatgccccgttctacacccttgcgatcggcccctcgggtagcggcaaaggttgtgtcagccaggtgcacaaactggtgaaaccctggcagcggagagtgttcgacaattccttccgtaaagtggaggaatataaggtgaagaaagaggcctgggagctttacaaacaacagcaacgtcagtcgaaagtaaagaaaataccgggaaatcctcctgaaaatccccagcccgtacagcagatgcagctccatgtaggcggctacaccaccacggcgcgtttgatcgagcagctggaagcgaacgctccctacgcttccctcttgtttgaaaccgaactggagtctgtcaacaataccatgtcgcaggattttggcggctacggatatattctcaaccaggctttccaccacgaacgggtgagctgtgcttcgaaaaccaacggtactttcgttgccgaaaccccgcgtttgggaatgtttgtcaccggtacgcccggcatgttctcgcagctcgtgccctctaccgaaagcggactttacagtcgcctgttgatctaccggattgccgggggtagcgcttaccacggactgacggcctccgatgatgtctttcagaatgctttctattttgacgacctgggggtgagaatgttggaaatagccgaattcctggagaagtcgcctacgtttgtgagcttcaccgactgccagcgaaaaaggctcgaccgttacttcgaacgtgaatattataatgtacgcgtattcgggaacgaagatgtcacttcggtagtcttgcgccaccgcctgataatcttccgtatcgcgatggtgctgacggccttgcgcaaaggggaggcgcgtgtcgacgaacgtcaccggagcattaccgacaacgatttcgaaatagcgttccatatcggaaccgtctgtctgcgccattcgctcctggtgagtaccacgatgaaacatagcgataccgagattcattttaaggtgcccacagccctgagcgatctgtttgcctccatgccggacaggtttaaaaccgctgaactgttggccgaggccggtgtccgcagactaagccgtgcaagtgttttccgaatgttgaaaaaggcacaggaatatggcttattgctttcattaggagcgggttattacgaaaaaacagtgtcgggaaaggatatcgctacttcggaaaaggggtagatacttttgatactattgatacttttttgataatagtatcttctctttatgctgttgaaaacgggtagttaccggtcattcaacgggtagttaccgaagctctgacgggtaggcatccgttcggaaacgggccgtaaggggttgatctattaacaaaaattcagaataaccattcaggctatgaatagcaaggcgagagatcgaaaaaagactgactaaaaaaatcgatcgttttttctcgtcacaaaggtactgcatcattttgaaataccaatcatttctactaattttttttctttccctatcttctttcttatcaatggaatagcaaagcaagtacgaaattacgactttttgacatcaaatcaaaattctcgaaaacagtgacgagaaaaaacgatcgttttagctagtcattggtatgacaaacctgtcgggaacaggttatgagaggttatttataacactattattaatattaaatttattgattatgaacaaaaagttttctacgttagtggctgtcctcttggcagccggtgcttggacgacgctggatgctagagtgattgaagtcactaagccggcagttggtcaggctgtagtgattggtagtaatttggatgggacaggagaaggttctgtcatttacctgaatgccgaagggcatgcagctgcggttgaaaaagaagtgactgctgaaactgctacttgggagttggaagctgttccgacagttgaatccaaatctgaagaagttgcggtaaaatattatctgaaaacaaagaatgccaaaggtgaggctgtttatttgcttcagacacaagttgtagaatctaaaagtggagattcgtatacttattcagtaggagcaaaagaggatggtgtaactccggttgaaatttctattgttgaaggtcgaattcaagtagtggaaggtgatgctactaagaatctgaaattcggtgagagtgcaattactgctgaatctgtagatactaaagctgcaacagaattaacaacagtaaaattcggtgtttacagtgctgacgatgtattccccggtactggtgatgtggctgtgaatgaagatggtgaggtaacagacttgaacagctttgttgaaaacgcagctaaagcaactgcttctttttatctgcaagtagaaggtggatatttgtatgtggatggtggcgaagtaaaagtttcagaaaaggtttctgctactgctgcttattcctggacattggatgcagacaaaaagatgtattcagtcgctttggatcgtgcaaagagcgatgttaagtacttgggtgtgaaagctgaaacgaaagctgctactactagctggactttggtgaaggctgctgctgctacggaagttactgttgcagacggtgctttgactgtaggtactgctacaatcagtggcgtgtctgtttcagctgtggctccgactgcaactaatgaaactattacagtaggtggtcagactctggctctgcaggcttctttcaacaatggtgaatattatttcatttcaggaaataatgctagtaaggcttggaaaggtgaagaagatggtactgtttcggctacgacagctgtaaatgcagacaaatgcctttgggcagtagaagatgcatctgctaacggcgtaacaagatacaaattcaaaaataaagcaaccggcaagtatgctatgctaaataaatctattgaatttgtttatacagctgcatataatagcggtatgtatttgtcgatcgctaatggtgctaacctggatgctgaccttacaaatacaacagatgctgtttctttcggtatctacaagtcaacaaccgaaaatgttgatgctaaagagctgaatgatgttttgggtaatggcttcggtcttagcatcttgaaggtaaaagatagcaaagacaaagtggaaggtatggatgctttcgatggcaagttaacagctattgttccgaagaattcagaggctaaagatgttgaaacattccagttggtaaatggtgacaaatatgttgctctgactttagccaatgaatggggtgttgaaaatacaggtgtaaacaagagaggtggtaagttcgttcttatcgatggaaaagaactggctaagaatgcagataaatatttgacttatttcactatcaaacgttactctggtgttgccgacaatctgatcgaccgtgtttctgtttcagataaagctacagctgctactgatacaagaaatctgtacatcatgaagttgggtgaggatctggttctgacaagtactgttagtacaattaccggtgaaacctatccgtacatcacattgggtctgaacaatgtagctagtgtaaaacagttcttgggtacattctggaacatttcttttgctgcaacaaagagcgaagtaacagaagcgaatgaatataaagtaggtcgtgcatttgcaattgaagacaatgctcctgaatatgtttcggctagctctgttgaagcaggtttccctgaagcacagtgggctgtaactgatgccaacttgaatacaaatgcgtttactttggctaaccgtgaaacaaaagctaaaattgaaaatgtagtattgcgtgaaacaagtgaaaagaacgtatatatcgttgaatcggtagaagttaataaaaacttggcagcaggcgataagatcaaactgactgcttacgaagatcctactatgttcgacggttttatgcaggcaactgaaaacgcattgagaaaccagaaatattatatgggccagtaccatgctatttcaggaaacaagaatgtgtatttctctgaaaaccatcagaagtctcatcaactgggtgttgtaaccgacaaaaatgaagcaactctttggaacctgagcttcagaatgaaagattatgacggtggtacaaagaatgctgtcgatacagtatttgttgaaacagtattcgcaactttgatcgacggtaagatcgttactgatccggataataagaaagtagagaaatctaaactggctatccttccgtatcagttccagaacagaagcaataatgaatatgttgtttacaatgacggacagggctacaagttctatgttttgaatcctgacaaaaagaaggaaaatgcttatagcttcgcattgaagaaacagccgaacggaacttataatatcgttcagttcaaaaatgcagataatgaaaatactactacagacgaaagacatgcattcgactctaagatttatgtagctaacagtgaagtagacggtttcggcgaattgagacagatgggtacttatgctaccgacaacaactcattgatggttgtagaaaaagcagatgcacctgaataccacaagatcgctgttgaatggggtgacacaatcagcttgtatcgtgaagaaaacaatgctcaggtattgtatgaaaaacgtgataacaagtctgttgttgaaaaggatacattgagcttcctgaacatcgataatatcaaccagttcagcgtaaatccggctatctttgccgatacagcttacatcaatcgtactatcgacggtgaagctaacacttgctaccagtacttactggctgtaaatgtagataaagaaaagactcactactgtccttacaatccggaacacaacactgacgaatggttggctgctaatggtggtccttgtgctgacgcaaaagaacacaaagctgttaagggtcgcttcctggtgaatctgatcgatacggctaatgtttacggtgcaactcacctgcacaacaatccgtatgtaaacgaagttgaagccggtgaatctcgtgctaaactgtcattcgtagaaggtgttcatgctgacgatactctgtatattactcgcaagggtggtgaaattgttaagttggctatggatacaacagacttcaacgtagctaagtttgctttccgttatgtggataacgatgctaagacattcaagatccagactcagtggaagaactatttcccgactgaagatgcagaaatagttgaagaaacagcaaacaacgacggttacctgaaatggatcaacggtacgttggttgtagaaaatggtttcgaaaacggtgatgtattcggtatcgaagaaaacgttaagcgtgatccggttgctaacgaagatatcacaacatcttcaatcagcgtaattgctaaagaaggtgcagtaataatcaagggtgctgctggtaagaaagttactatcagcaacgtacttggtcagacaatcgctaacacagttctttcttctgacgacgctacaatctctacacctgccggtgtggtagtagtagctgtagaaggtgaagctgctgtaaaagcaatcgtaaaataagcaattatttaaaatcaaataattctaaattgtttaccgcgtgtcgtaggggcggttcgcgaaccgcccttaccccaattaccctgcgacaggcgaacaagcggtagatattaatactaaagtaatgaaataaagttcttctgttcgatctctgtgaagagcaacaacagacaaaacaaagccccgacaggatttcctgccggggctttcgtatatatagaaagagtttagtttttttgtgaagcaagcatttatttgctcaaacttttcccggattattaagttcgtccaccaggcggaagaccattgtgcagggattatgtttgacatattctgttgtgtcgaatgttccggcaagtttctccgcccattttatcgcttgcgcttcgttgccatatttcagtagtaaatcatgcatatctttagcatttttgcgatagatgaattttccttttttaccgtcttgctccagtattttctggttcatttccttttcgatggcctgatgaaaccgggatgcaggaaagtcgtctttgtcgaatacagcccatacactgttcagaggcttagggctgctttttttgagctcgatagctgcattgacaacgcccaacggatcgcacccttcgccttgtgtttctatatccagtgtgtagggtggaagactgttgttgaacgaagaaaaataatgaggttccgttttctgtccttcacaaacaatgaggaagtaaactcgctgattacgggtgccgactgcccgtttattccgtgagccgtctcgttcgaaacgattgtggaaactattgatgtcaatcctctttgccatatttcatcagatttgaaaaatcaccaatgaatggaatggcgccatagcgtccttgtatataatctttctcgtagtttcggtcattacgcacttttgtgccgtccggatcgcggaactcgaccagcgaatataggtcggtttgctctttctcatctttctcggtaaaccatatctgatcgcgccggaaacaatcgcaacccaacagattggtgtcgtgagtggcaaagatgagttgggcacctcttttgtttatttccggagaatggaacatctctatgattttctttgtcagtaaagggtgtagtttggcatcaagttcgtcgataacaagaggtagaccatattgtaaagtgtataaaatgaatccagcaatgtcaaatactttattagttcctgcagattcactctctgtaatgatgaaagaatgtttacctattttattgcctgatatatcatatatattatgaatagtattagctttatctcgccaattatattcttcattgagtaagtctatatcaataaatcccaattgcaggtcttggaagaattttttagttagttttgattcgttttttagatatacagatgtcatacttttaaatggatcatgattcactccagataaaatacgaatatcgtttatactttcaataatttcttttgctcgctttacattgaattgatcgcaaacggagagaaaaagaccattgtctcttgttcgctcttccaatccctttgcttctaaaaagatgtccgaaatgccaatgctttcattttcccgaaggaaaagaggttgttctttctttgctcctttgggaactgtatatagccactccgaatggattttatcattatctaattcaaaaccgtatctatagtattcttcccattggataaataatatctcaaaataagagggaagagagcggttctcttttgccaacataaaaggagatacatttagtttatcggtggaattgagctttgaagagttcatgattgtatcttgcataaattttaaagcctttatcaaattactctttccactggagtttgctccgtagatagctgcggatttaagtagcttgtaattggctgttttcaatatattatcgggaagctctttgatattggaggcttccatacttaatgttttcttatctttaaaagataaaaaattctctacagtgaattcaatcagattaatcattgtcttgtttgttttgagagatattctcgcaatttgcttcaaatatacctataaaaacaatgtattctttaattattgcgattttttctcattcattacgctatcgccatcgctagcacgctcacccgtacccccggtacggtcagtaacgcttcggcgcaggctccgagagtagagccggttgtgatgacatcgtctatcagtaagatatgtttgcctttcagggtttcggggttggtgacgatgaagatttcctgtacattcagccaacggtcgtacacctgtttctttgtctgtgtttcgtttgcccggatacggcataggctggaggtgtcgaccggtagtttcagtacgctgtttatgccccgggcgatccattccgactggttgtatccgcgtttctttttctttttggaatgaagcggtacggggaggatcagatcgggaaggtcggagaggatagattgacggtagtccagtcccgccatgcgtcccagccggaaaccgatctccttattatcgttatacttcagttcgtggataagctgttgcacgtgccctccccgctcgtaatgcaggaaagctgccgcatggcagataaagactttaccggtgaataaatgagtggcggggttctctttcagatagtcgaacccggtacgaggcaggtcgcacagacatttgaggcagaaatgttcctcacctcccataagcgggtcgttacataacaggcaaagcttgggaaagaaaagattcagcaggttattcaaagtcttcctcataatcgttccctttgaataattgtttcaggcaacgtattgcttcacggctttcgaaaccacggccggcggcaaagcggaggagtttggtgtagatatctctttcgtctttccctttgacagactttttctttgctttcaataaggcaaggaggataccttcatattctttttcgtcgattctttccaacgcctccgaacggatggaggcaggaatgtttttcttatgtagttcgtatgcgatcttgatgcgtccccatttgttgaaacgcaacttgtcgttcacgaaataaccggaaaaccggctttcgtcaatgaacttttcctgaagcaggcgggcaatgatacgctcgccttcctcagaggtgagaccggccgcttgtattttcttctgtacgtcttgtatgcaacgttcggcagtagagcagtaggcggctgcacgacgcagcatttcggcttctgttatctgttccatgtctgtgctttcacaaaacggtcttttccggacaagtcttgtataagttcgacattcttgaattccatcaggcggagcatgttgaccgtctgttctcccagttgtgagttgatctcgaagtagatatatcctttctttttcagcttctgttctgcaaacatagtgatgcggtggtaatacaataacggattgtcgttggggacgaacagggccagggaaggctcatagtcgagtacattcgggtccatggcggctttctccttctccatgacgtaaggagggttgctgacgatgatgtcgaactcttcttcgatagaatcagccgtttttgacggggtcaggatatctttttgaaagaaggtgattacagccctgttgcgtaccgcatttcgtttggctgttttcagagcctcttccgaaatgtcgagcgcatatacttgcgacttgttcagcaacttcttcaaagtaatggcaatgcagccgctaccggttcctatatctagtatatccagttctttcttttgaggataatcgcggacgatcagttcgaccaactcctcggtttcgggacgcgggatcaatacggaaggattaacctcgaactcaaatccgtagaaatcggttttaccgaatatgtactggatcggttcgtatttggtgagtcgttctactatattatgaatctccgacttttccttctcggataattctttatctttgcaaagtaagaattgatgtggctgaatatcgcacacacgttccattatcaggcgggtgaatgccttgatttcacttagtggataatagtctttcagcgtgtcttgtatataagcgacggtctcagtcatgataatttaattttagtgcaaaagtaatgtaaaaaccatttataagcaaagaaaatggtcgaggttgaaaataaatatatggctcgttgtatttcactggcccggggtggagcaggaaatgtggcgcctaatccgatggtgggagccgtggtcgtgcaccaaggtaaaattatcggggaagggtatcacaggaagtgcggcgaagcgcatgccgaggtgaatgcgatcgcttcggtaaaggatgagtctttgttgaaagagtctacgatgtacgttagcctggagccttgttcccattacgggaagacgcctccttgtgcggaattgatcataagaaagcagattccacgtgttgtgatagggtgtctggatcctttccctgaggtgtcgggaagaggggtaaggatgctacgggaggccggagtagaggtggtgaccggggtgatggagcaggaagcccgggagttgaaccgcgattttatgactttccaacaactgggacgcccttacgtctatctgaaatgggcgcagagtgccgacggttttatggatcgggtacggacggacaattccactccggcagtcgttctttcgtcggcagagatgcttcgcagggtacactgtatgcgtgccaatgtggcggccattatggtgggtacacagacggccttgttggataatccgtcgttgacggtacggcattgggcgggaaagtcgcctgtaagggtcgtactcgacaggacattgcgtatcccttccggtaatcatttattcgacgggacggtcaagacattggtctttacggctgaagatgcggtgggcagcgaaaatgtggagtatgtaaagattgattttttacaacctgtcctgccgcaagtcttgcatgaattgtatacccgtaaactgaattccctgatggttgagggtggtgctactcttcttggacattttttacaggaagatctctgggataagatgtttgtcgaaacagctccggtttttctggaagcgggtgtaaaggcaccggatataaatctggctccttctttgtcgttaacggaggtgattaaacgtcaggatcatgtaatatctgttttttcacggaaaaatcagtgagcgaagtagtttaacggaactaaaatattataaatattagccgatattgggtataaagcaaaaaatgtttctacttttgtggctttatatgcaacaaacttatttttggatgaaaaatagaatagtactatttgtagcgggatgtattgcattgttattgtcttcctgtctgggatcggacgataatgagtatgagttaccaaaggattgtcagattacttcttttacagtaaagcatgattcgattcttggtggcaagctggatacagtgaagtttgtgatcgaccaggtgaacggacgtatttttaatccggattccctgccttttggaactgtaatagaaaaagtagtttgtacggtaacgtatgctaacgggatggcttctatcgaagtaacccaggacgccttgcccgattctacctattactggaatttgacagactctttggatttctctaaacccgtaaagatggtgactgccgcttatgacgggattgccaagaaaacgtatatcgctcaggtgaatgtgcatcaggtggtgcccgactctatgtcgtgggatctgtatgcagataatgtattcggtttccctgtaaaggaacagaaagtggttgcctggggatcggaaaatgacgagtactattatatgtacatgcaagcagctgatgccagcaagggatactccttgaagagttcttccgtgtcggatggaagaagctggacagagctttcgttggaaggtctgcctgccggtgaagttcgtttgtcgcagatgaccgaatatgaagatgctttgtatgtgcctacaacgaaaggcgcactttatcagtcggttgacggacagaagtggacgcaggttgaccaggctccgtcagttaaaacggtattgggtgcaataaaaagcggtggtttgaatcaaccgtcggctttggctactattgtcgataataacggtacattgaactacgccataatggataaggatcagaaatggacgacaggtgatgttgttccggccggtttccctgtgagcggtttcggttctttgtcgagcctgaatatgttccgcgaaagccttacggtcgttgccggtaaagataaagacggcaaactgctgaatgcagcctggagtacgatgaccggtgcttcatgggtgctgttaaccgatatggagtcggattatttcgataagagagaaggggttatgctttctgcttacgatgataagttctgtatggtcggcggtatcgacgaatcgaataaggctttgaaagatatttatttctctatagatggtggtgtgtcgtggacattgtcggatacattagctgttatgccggaaaattataaggccagaggttttgcttctgtgttggtggataaagagaaatttatgctgattttcggcggtaaggagaacaatagtgcaaatgatctggatcagatctggaagggacgtataaaccgtttaggttttaaggattgataaagttcgtggaggaaagtataattttaggaagaatttgacgttagaaaaagaagtgtagtaatataatagcattgtttatgacttcaactttttttcaacggattcttatactgatactgctggccggctcatttatcggtctccatgcacaggaatataaatatgaaataggcgggatggcaggaggcgccttctatatgggggatgccaacaagaatgctttcttcaaagggatgaaccccgcggtaggggttgtgttccgttataatcccaacttcagatgggcctttaaaagcaatctgatgtgggggcaggtatcgggtaatacggaaggactggaaaatgtttttccggacaatgcgcaagcatcgttcagccgtagcctgatagagctgggcggtcagatggagttcaacttcatgccgtacagtgataaatttgcttatgcaggagcgaagcgttttactccgtatgttctcctgggactgggtgtcacggtgggtacagggaataagatgtttttcggaccgaatatcccattaggggtaggtgtgaaatataaggtcaagaacaggatcaatctgggttgcgagttctcgttccgtaagttattcggagataatttcgatgtgacggacgatagcaatgcaatattggataatccctatcagaccggtggcagtttcttgaagaacaaagattggtattcatttttactgctatctgttacctgggacttcggtccgcgtaacaggccatgtaatagtataaacagcaacagtacgtttagatactgaaaacactatgtcattgattgaggaaatagacaaaaatcgcttgccgcaacatgtggcgattattatggatggaaacggacgttgggccaaagcgcaggggaaagaccggagctatggacaccaggaaggcgttgtctccgtacgtaaagtagttgaggcggcaacggctattggactgaagtaccttacagtgtacaccttttcaacagaaaactggaatcgtccggaagcagaagtaaaggctctgatgagcttgctggtgtcggccatccatcgtgaaacgccggatctgatgaaaaataatgtccgtctgatggctatcggtaacttggaccgtctgcctgaagatgcacatgccactttgctggattgtataaaacaaacatcagccaatacaggtaccacgctcgtattggctctcagttattcttcccgctgggagataacggaagctgtcagacagcttgctgttcaagtgttggaaaagaaaataaaccccaacgatataaccgaggcagttgtctcggaccacctaacgactaaaggcattcccgatccggatctattgatcaggaccggtggagaaaaacgcatcagtaacttcctgctgtggcaggcgtcttatgcggaattcttctttaccgatgtgtattggccggcattcagagaagaagagttgtatgaagctatattgtattaccagcaacgcgaacgtcgtttcggtaaaacaagtgagcaattaatcttataaacaatagctgttatatgtacaaaagaatagtgctgttttttattttcctaggttttgcctgcggagcatttgcccaggaaagtgacactaccaaggttgaagcaccggcagaagtgccggtcattaattattcgtttcccaaacggtataagattgccgacattaaggtaacgggtattaagaattatgatgatttcgtgttaatcggtttttcgggactatcggtcggtgacatggtcactatccccggagacgagattacaacagcggtgaagcgtttttggaaacacggattgttttcggatgtaaaaatcctggcaaccaagattgaaggtgacgaagtctggctggaaatccagttgaagcaacgtccccgtatatcggaagtaaattatcatggaatcaagaaaggggaaagggaagaccttgaagccaagttgggcttgaagaaggggttccaggttactccgaacctgatggaccgtgcgaagatcgttatccagaagttcttcgatggaaaaggatttaagaatgtggatgtggatatcgttcagcgcgacgacctggcccatgaaggcgaggtgatcgtagatatcaatatcgacaagaatgaaaagaccaagatccaccgtatctattttgaagggaatgaggctttatcagcacgggatctgaagaaagcgatgaagaagaccaacgaaaagttcagtcttccgaacgactggaagactagtatcctggaagcattcagcaccaagaaatttacgaccgaagaatatgaaaaagacaaggctaacatcatagccaagtataacgaacacggttatcgtgacgcagtcttgttgtccgacagtgtcgttaactacaatgataagaaagtcgacatcttcctgaagttggaagaaggtgacaaatattacctgaaagatattcgcttcgttggtaatacgcagtatgcttcggattatctggaagcaattctgggtatgaaacctggcgaagtttataaccagaagaaattgaacgagcgtctgtcgctggatgaagatgccgtatccaatgtatattataacaatggttacatcttctttagcgccgacccggtggaagtggatgtggataacgactctatctcattggaagtacgtattcaggaaggcccgcaggcaactatcaaccgtgttattatcaatggtaacgaccgtttgtatgaagatatcgtacgtcgtgagcttcgtaccaaaccgggtatgttattcagtcgtgaagacctgatgcgttctgttcgtgaaatagcccagatgggacacttcgacccggaaaacatggacccgaaaccactgcctgatccggagaacggaacagtggatatccagtataacctgacatcgaaggccaacgaccagatcgagttctcggccggttggggacaaacgggtgtgatcggtaaattgagtttgaagtttaccaacttctccatgaagaacttcttgaacccgaagacatataaaggtattatcccacagggtgaaggccagactctgacattgagtggccagaccaacggacgctactaccaggcatacagtatttcatttatggacccgtggttcggcggaagacgtccgaatacactttctgtaagtgcttatttctccaaacagactgacattagcagtaattactataataacagcatggctaactatggcggttattatcccggttacaactatggtggtatgtatggtggctacggtggttattataacaactactataataataactatgaactggcatacgacccggataaatcgatcatgatgttcggtctttctgccggttacggtaagcgtttgacttggccggacgactacttccagtttatggcaacgctgaactatcagatgtatatcatgcacgactgggcatacttcctggttcagaacggaacttgtcacaacgtaaacctggagttgatgttacagcgtaactctatcgacaacccgttgtatactcgtcgtggttcgcagttctctttctcagttagtgcaactcctccttactcattgtgggatggcaaggattatgctaacatgagcgacaatgacgaaagcaagttcaagtttatcgaataccataaatggaagttcaaagcgaagttgttctctccgctggctcctatgtcagtaaagcgtacaccggtattgatgactcgtgttgaatacggattcttgggatcttacaacaaacacaaacgttctcccttcgaaaccttctatatgggtggtgacggtatgagtggatactccagtacttatgcaactgaaactatcggtttgagaggttacgaaaacggaagtatcgccggtaacggaggttataactcgtatggttatgcttactcccgtctggccatggagttacgttatccgttcctgttggaaccgtcttctactatctacggtcttgtatttgttgaagccggtaacgcttggaaagatttgaagagctttaatccgttcgacctgaaacgttctgccggcgtcggtgtacgtatcttccttccgatgatcggtttgatgggtatcgactgggcatatggtttcgacaaagtagatggatctcgtagtgcaggtggtagcaatttccacttcatcattggacaagagttctaattgtaagcggtagattaattgaaaattaacaattcagcattaagcgttaaccataattcattggaacaaagtaaaccctccgctatatttgtagtcagagagtgaaactataaaaagaaagcgtatgaagaagattattgttttgagttgtatgatgctcctttgctcttttgccgggatggcgcaaaagtttgcattgatagatatggaatatatcctgaagaatattccggcttatgaaatgacaaacgaacaattaagccaggtgtcaaagaaatggcagaatgaggtggaagcaatacagcaggaggcgcaaaatatgtataagacctatcagagtgatttggtattcctttcagctgaaatgaagacaaagcgtgaagaagaaatcgtgaagaaggaacaggaagcgcaagacctgaaacgtacttatttcggacctgaaggtgaattgttcaaaaagcgtgaaagcttgatgaaaccaatacaggatgaaatttataatgcagtgaaggaaatatcggaagacaagggatatcaacttgttgttgaccgtgcttcagctatgagtattatttttgcatctccaaagatcgatatcagcaatgaagtgctgttaaagttaggatattcaaaataaatgcttacatttgtgcgctttatgcacaaaaaaaattgattgattaataacaagtaatattttatagaaaatgaagaaactgattattttattgttgatgatcctcccgttaggagtttttgctcaggacatgaaagtggcaattgttaatacaaacgaacttattcctttaatgcctgaagtaactgctatgcaggaaactctgaaacagatgaatgacaagtacatgggtgaaatgaagaccatgcaggatgaatacgaaaagaaatatgctgactatatcgctcaacaggattcattgactgaaaatatcaagctgagaagaatgcaggaactttcagatatcgaacaaagagttcagaacttcactcaggtagctcgtcaggatatggataaaaaacagcaggagttgtttacaccgatccaggacaaagtaagaaatgcaatcaaagctgttggtgacgaaaaaggttatgcttatatcctcgattctaacccaggtatggtgctttacactggtagctcagcaatcgatgctactccgtttgtaaaagctaaattaggtttgaaataatacaatcaaaagtacgatacaacaaaggatgcctttctatgaagggcatcctttgttgtgttataaaagaaggaagaatatgttttcacaacaaccgggtccgatcggagtttttgattccggctatggcggactgactgtatttgacaagatccgtgaggcaatgcctgactacgattatatttacctgggagacaatgcccgggctccttatgggccgcgttcgttcgaggtggtataccgctttacgcgtcaggcagtgatgaagttgttcgctgaaggctgccaactggttatcctggcctgtaatacggcttctgcaaaggctttgcgtactattcagcaacgtgacctgccggtggtcgatcccacacgccgtgtactgggcgtaatacgtccgacagtggaaatgatggatcgggtcagtttaacgaagcatatcgggatactgggaactgcaggcaccatctcttcccgatcttattcgcttgaaatagagaagatgttccctcatataaaagtaaccggcgaagcctgcccgatgtgggctcccctggttgagaataacgagtttgattctccaggtgccgattactttgtgaaaaaacatttggatcatatcctgtctctcgactcacagattgatacgctggtattggggtgcacgcattacccattattgatcggtaagatcaaacaatatctgccctctgagatcactgtcttcgcacaaggagaatacgtagcggtgagcctgattgattatctgaaaagacatcctgaaatggatcggaagttgacccgtcatggtgaatgtcgctttctgaccacagaatcggccgggaagttttcggatgctgcctctgtctttttgaataatccgatagaagtagaacaaatctctatcgactaaggaggggggatatgagacaagtccggcatatctttttatttctgttgctgctttcttgtttgcatggcaaggcagaagaactggatatctggctgcaaaataaagggatggtggatgtatccgcatgggattcgactatttgtgtgcagctcgtttatgcaacctccgataattttataggggaagcggtttattccggtattacccgtgcctggttgcatcccgatgctgccaaaaaattggttgtagctcaacatttgcttaagaaagaacacccggagcttacgctggtggtatatgatgccgcccgtccgatgtctgtgcaacggaagatgtggagtctggttcgtggtactgataaagtaaattatgtgagtaatccttccaacggcggagggttgcataattacggaatggcagtggatgtcacgatcctggataaaacaggccagcctttgcctatgggaagtccttttgatttctttggggaagaggcccacaccaacaatgaagaagttttgttggcctctgaaaagataacccgtgaagagtttgataaccggcgtttactccgtcggataatgatgaatgccggatttcgtacgatcccttacgagtggtggcattttaatgcttgcagccgggccgaagcccggcaaagttatccagtattggattaattaatattcttaccgaatggagtcagtgcaagagctgccatcttgaaatgctgtcttccccagggtatcccgattatcgtgatgcacaataaaagaccgaatcccaaatgagtcaggcagatccagaaacctcccaatatgatccaaagtatgttcataatgatgcaaaggcagcctccggagttaccgttgtccgtgactgtgctaccgaagggccataaggccagtaaagccagttttaacgtctgtagcccgaacggtataccaatgatggtgaccattaataacaggcttgagatcagatactcgatactggtagccagtcctccgaaaattaaccaaatgatattaccaagaaatttcataagccactgaatttatcatgttcacaaatgtaacataattctgattaaaaacaatagttatcgaagctgaaaccgacaggcatcgctttacctccgggcaggcatccgcagactgtccagttcggcaaacacctgttgttttacaatcataaagctatcgcgtagttcaggtttgaccggtagtgaaggaggagcttccatattcagtggattgatcggctcaccgtttttgtgtacacggaagtccaggtgaggacctgtcgataatccggtagaacctacgtaagcgatcacttccccctgttgtacatgacttccgacctgtatacccttggcaaatttgctcaggtgcatataagtggtagtatataccgagttatgctttactttcaggaaattcccgccaccgttctgatagcctttggcaataaccgttccggctccgatactttttaccggtgttccgacaggagctgcataatcgaccccatgatgcgcacggtaacgtttcaatatcgggtggaaacgagcattggtgaagcgtgaagttatgcggaatatatctaacggtgctttcaggaaagctttgcgtaaactgttcccatcctgatcgaaatattcgaatacgctgtcctgggtaaaaggaatggcaacgaagtctttcccctggtggttgaatacagctccctggatgctgtttatatttaatgcagtcgtgtcatcgatataagcaatgtcgtacagtacacggaacgaatcaccctcttttacgtcatagaaatctatctgccaggcaaagacatcggctatattgattgccagtaaaggattcacaccattcgactggagaacgttccatagagaggaattcagcgtgccttccacgtagtgcctttttaaggtgatcggtttattaaattcgtaagcgcgtatggtgtcgccggtaaggtcgatcacagcgtaatctgtccgcgacttggcgaaagcgatgtaacggatctgtgccgtactgtcctgcattgtgaatgtgtagtaatgcatacccgcctgtagtttggtcgggtcgagaacttcaacagacgaccggctgatactgtcagccatcaaagcagaaaagcccaggctggaaaaaatagaagccgggttgtcgccgttcttcatcttatagtctttcacgtccagtgtatctatacatacgccatattgatagacgcgttgctggctgtcgatccattcgctgtcgacttcttcttcggtttgttcgggtgtgtttttacaggagagacctagtatgaataataagatcaaaataggtgcaatgttgaatcccttcattatatcctcttttattgtttatccataaaactgcaaacttacggaaaatataaagtggtacattcgcatgatttgtatccatttgttaatgttgactaaatagcttacttttgcgaaacaatttggacgtatttgacgtcttattcctgtaagtgatataacaaatagtatagattatgaaaagagtaattttttatgtattaatgctcccgatggtattggggatgatgatttcttgttctgaagccaaaacagacgctaagaaactggaaggtaaatggaatgtaattgaggtaaaaggcgaaaagatcttgaaagaaggattacctccatatatggaatttgatatggcgcagaataaactgcatggtaatggcggttgcaatatgttcaacacctccgtaacattggatgacaacgatgtatcttccattacgatcgctccggctgccgcaacgatgatggcctgtccggatatgtcgacagaagatgctatctttaaagcaataggagatgtgaaagctgtaaaagccggcaactctgaaagcgaaatgatgctggttgatggatccggtaatgttttgtttgttttgtctaaaaactaatcagagatgaagaagtatttatttctctgtctggctgtggtaggtattgccgtatttgcttcctgtaaatctcagaaagcggtggttgccacattttccgatctcgacggtgaatggagtgtggttgaactgaacgggaagagactggacccggcagacagcaagcaattaattgtgatcgatgttgcccgtaaacatctgtccggtaatgccggctgtaaccgaatgaacggtaacatcgagtatacggatgcacagaaaaacatcatcaagtttccgcaggtggctactacccggatggcttgtcctgacatgaaaggtgagcaggagtttttggatgcattgaacaaggtggttcgttttcaggcggaagggctgacaaaaccagtgaatacagttgctctctatggtactgacaatggaaagttgatggttattcaaaagaaataagtgataattgtaaaataggagaggtggccctgttgaaggaagccacctcttttcagttcaaagatagagcatagttgcataactctctgacttcgccaatagtctcgaaatctatcttatgaccatcaatatattttttgagttgtaccttgtgtttagagaagagtttcaggaattgtttctctgttgaaaattgtttcaatcgtttgtttatttcgacataaaactgaaaatctattttaacaagaaccgtattcttttcgttctctcccgttccatagataagattggaatagctatcgacagaagctgtttcggtttttccgccgaaagtaagatcttttttgatgcgtttgtttccggtgtatcggactaatatgcgtggttcggtttgtatgacttctgccacttcctttccataaattggaataaatgttcgggtgcctgcctttatagaaacgattttttccggatctgcgaattccttcttttcgttgtctttatcgataaacacaaatttgttgtcaaacaggtcgtaattaacgggaaccaggaaaactcttccgtctttatagtaaatatatgaatctgtaaattccggaaataagtatggggaatgtttttcctgtgcaaaaacatcagaaaacctgaggaaaacgactaatagaattaagatgtatttcatattgttatttgaaaataataagatagagaatagaaaagaagagaaagtagtgagagtttttactcttcactactttcttttttgttatttcgacttcttacaacgaatatgaagtcttttctttcgcttcttcggctgtaacttccagtaaatgtacctgaacctcgtataaacgtttgtactcaggcgcaccttccggtcggatagctatgttggttaccatatattgctgtggttttgtataatcgcccggagttcccagattaggcgctccgttaacgggatctactctgcaagcataaatgtctttcattataaactccagaaccatctcgttttgttttacaggcataacgacatagcgatacatatcttcttttgcactctttgcatcactttctattttttcgaaataaccgtatggttttattgtttcgttgtcgaatgcagattggataaaagcatgccctttattaggggtgtgataacccactttatcgaaagaaaatatatgagcaatatattttttcccttccggtgcggaactgtcatctacaatttccaatgtgttttttaccgtcattttctctcccggagccaatgttttatctaaaatcgtgatattagatccggtattgtttacatattccattccgttttcgaaagaattgagtagtgaccgggcaatataattttccaaccactgtcctttgccatcattatggttgatctgccatactttatttacaaaaagttcccggggacgatttcttactaaaccggttcccatatccagttccgaatataccgactcgggtacttcatcccagacaattccgctttgacagccgtaaagagccgttatagcgaatgttattgcgaataatatacttttgattttcatgactttgttatcttttaaaataattattgatagcttctgttttcccatcccggattttgaacaaaattgcgattcacttccaaagtggagcgtgaaaaaggtagtttgtagaatacggcatcatcgaatttacgatcataatatacactttgatcaatcgtgcgaacgtagaaataaggagtaaagtatttagggtcacttttgggtgccaagtatccgttaaggcctacttcttcactttcaattcctttacggaaaataaacatacctctggagtttttgtttaattcgtcgataacagttttaccttccgactctccccacctgagcaggtcgaagtagcggtgcccgggcacttcgaatgcaaactcgatacggcgttgtaatttgtattcttcccacaggtcgtgaccaactaccgatgcctcgaagttatcgagacctgcacggttacgaatctgattgatagcatctaacgtttcattttctttacctcccagtttataagcagcttcggcataattcaataatgcttccgcataacggaccataaagtagcaggagggtgactgtgtgccgttgacagttccgttttcgttgaaacgtccgatagtatatttagcggcataatagcttgtaaccgttgattgggctcctccggtgatgtctaacttttcagtgtgtttgaaataggttcccaaagaactgtatttctccgatttagtcggttccgaaaagtcgatccaggtacggatcaggtatctttcatgctcggcaccggcatagtaggtgctgtcgtggaggatagttgcataaaaacgtttgtcccggtcggtatacatatcgaggtagttttcgctggttgcggtgaattgtccctggtcattttgggttagcccgagttctttcgactgggttgttttccaccattgcatccatttgccggtcgctttatctttctggtagtagcaatctaccaggtcctgagttgggtatgcacctccgcgtccaccatcccagtccggattgaagtcggttgtacctccgtacattttagcccaggaaaccggatgtgagtaatagccggggttgaaacctgacctgtttgattcgttgaacatgacgggccagatagattctaccgacgtatgaccgttggatgtgttaaacagcttggcataatcggattccaactcatatttgcctatcactgatttagctgcttcataagccatttgataataatgcccggcatctttcgtgaacttataaagtgttttgctttcgacagaaccggccaactgatcatatagtcctttggctgatgcttcggccgcacaggctgcagctaatgcactgcgtgatttcagtacttgtacagcattttcattaagcaaacccagagtcggtttaaccgatgcttttttgaataactccaaagctttgtcataatcgcttaggatttgatcgaatacctcttcacgactgttttgaggaagcattgtttcatcgaagatagtcattgtattggtgatgatcggcatgataccccaatatctttccatatcggcatagtacagggcacgaaatgcataactttctgccaatagctgacttgattcttcttcagtgatgttgggtacttccggaatgcgctcgatggccagattcgtttgacgtatccgtttgtatccatccccccagggggctccgactataccagcactgttcatttcgtcataccgtctgccgttatagtcgtattgacggaatgtattctggtcgcggtctatattaccacatgcattgtccgaccattgctcggcctggaatgcctggttagctccggcaggtccccataaatagaattgattgacgaaagtacgcgataactgtgcgtttgcccagaattgatcttcgaatacactggtggtcggttcgattcccagcgggtcacaactggagagacaaaccgcagtgcataacgctaatatatttaatttcttcatttttcttatgttataatgtgattacaatgttaatgttgcgctcagtgtgaatgaacgttgtgtaggataactacccagtttgttgcctccccagatagagttagccggcaagtattcagggtcggttaaattgtggaacggatttcctttctttacccaggtgcagacattattggctacaaaattaacctgcaagcctttgatatagcttatgtttttgagaacccggcgtttcaggtcgtagctgacactgatgtttttcagtttcagataagaagcgtcgtatacccaggcatcgacataattgtatccccagccataagtcgagttggtaggcaatggaagtttattggtaataggattacttggggtatatgattccggatacaggtatttgccataatgccagtagtagtcctgttgtgaacgggccggtgaagtgacatcacctgtcacattgcctgctccctgaaagaatacttcaaaactaaaatctttccaacccactcctaatgtgattccgtaaagagattgaggaactataccccctctttcttctattacctggtcgccgccatttaacacaccgtcaccattgatatccagcatacggaaggttcctaatgcgtggttgcgtccgaagtgcatatatgaattatacatgtcctgatatgaggtaaacaaaccatttgttttccaggattgcgagtatgtatcttgtacattgtttttacccagatcgtttaagttgggataatagtagctttccgattgtttggcgtgccttaccgccacttgttcccaataggtatagtttccaccgattctataggtaaaatcgccgatgcgatcgctccaatttaaagaaaattcaacaccgcctttgtgattggttacataaggtgcattcattttgggcgtattgggcagacctaaaataggtgtataggttatttctggattcatgtctatttcttcccctttattcagatacagataagtatcgaacgagcctgtcaaacggtctttaaagaatccgaagtcgacaccaccactgatttgttgcgattcaccccaggtaaggttgctggaaacatttgtttcagtccaaaccgaattggaattcatgttttctcccaggaggatattgtttgctttgctatcgtttttggatagtccgtattgattcatatagctgaacgggcttgccagctcctggcctacaactccgtaaccgcctcgaatcttaaacatgctgatccagtctttatcgataatgtctttgatgaactcttcttccgtcaacacccaaccggcagatgctgcatagaaaaatccccagcgtttatccggatggtagcataacgaaccgttgtaattggcacttaattgtagcagatatttgctgtcgtagtcgtaagtgatacgcccaacataggatgccgatccccatagtccttctgtccctttcatttcctgcattgtcgctccggcctctatctgcggattataaatgcttgggtagccatatttctttgccatggtcgagtttgttctgcgcttttgactcgtatagttgatcatggcagtcagattatgtttgccgaaagaccggttgtaatctgcttgcaggatacctgtcgtcagtgagtagttgtcccatgtttgagataaattggcatcattcgggttataactgttttcctgtgttgcataagggctggagtatacgccgacttccggatgactaaagcttttgttcatcgagttactgtaattgaagttgacactaccgctgacagataatccctctacccatggtaaactccattttaaaccgatgttcgactgtagccggtagtcatccgtattgttgaatccggtacgcaagcgcgcgtccaaccctccggctctttccagaccggttgtccagttttgtggtattctgtgcatttcgtttccttcaatcaagacagagttgaagatgccgtcacccccctgtggttgcttctttttggccatcacgccatttaggttcagcgtgaatctcaggctcttgtctttcagcaggtaagcatctgtattgacaatcgcgttgtactgttcgtaatcgtaagaatcgctgataccggattgtttcatataacccagactagagtaatatcttaccctttcgctacctccgcgcacactaaggttcgtttgagtcatcggctgggtatgattaaagaaatcccaggcatcatagtcaccataatagttttcgatatcctttccttgagtaacgaacggattgaacaaatcgtttatatcaccaagtgagtatcctaaagcgtatttttgattgaccatgtcggtaatttcctggcgattatgtccttgcgaattcaaataccccatgtaatatttagacatttccgttgcgttgaaagcgggactttcggccatactggctgcatacagatcgtttttcatgtttacataatcccaggtactcatcgctttgggcctgtaagaaggggtcatcacggtcattttctgacttaccgatatttccaactggccttcctgtcctttcttggtggtgaccaccacaacaccgtcgcttgcacgggggccgtataccgctgtggccgaagcatctttcaggatactcatggaggctatatcgtccgggcgcaaacggttgaagaatacttcaccctggctggtttccatcaccacgtcatcgattacgtataagatattgctaccaccgcggatccagattttggaagtttcgcccggagctcccgaacgtgcctgggaaataataccggatacacgacctcctaatccgtcactgggagaggtaaccggtagttttgcgatcgattcgattttaacgttaacagcagcagccgttaacgtctttgtcttttggacaccgctaaaaccggtgacaacgacttcgtccagggcttgtgagtcttctattaactttacgttaatggaggcttgtcctgtgtacttgacttcctgtgtggtataacctacgaaagaaatttgaatgacacttccgaccttcacgtcttcgagggtaaatcgaccgtcaaggtcagtaataataccgtttgtggttcctttcacaatgacagaggctccggttacggggccgaattcatcttctactgtacctgttactttcccgttttgctgggaaatgctcacgctcggtctaatgggtgttgtgtcggcttttatgctctcgggagaacataatatgcctgcaaccaacattaaaccaaccggtttgaagttttttagcataatgtgcgtttttagtttgttattaattatgtaataggtaaaaaatatcaatgttgtttcggagttttccgatcatcgtccgtctacacctaacgagttggtagtaaaactgaattcaattgttgttgccatataatattagttttaattagttcatagagaactatggcgtattaggttcacggtctaaattattctaagaaaaagccgtatttatcgacttttatttgtggtcaaaaacgggttatgtgaaataaaagtttaattttgtacgctatatatcgaattattttataatatttgcaaaatgataaccatagttctctatggactaagattaattataaaatattttttctgtcttttcccataagaaacaatatcaaataactctagcgatccgtcttaagattcagatatttataatgtacaattagcgtaaattcgtttgattattgtttgtcgtaaaattttgtgagtgaaactagtttttacatttttagttatgcgtttattcttattgatatatgttgtgtaagttttgtctttttgtggctttgatgatagttgcaatatttcgggaaatattttttcatgggggctggctttctttttatatctgtttggcaggtatcttcagtgtaaagcgactgcctttgccttgtgcggaactaacctgtatatcccctttcaatcgttcagctatggtcttgcagatagagagtccgaggccggttccttgtgcaaattcatcttgtttgtagaatcgttcgaacactttatcgagtgcactctgtgacatgcctatacctgtatcttccacgtagatgtacacctgtttctcattcaggttataattgtatcccaatttgatgtatccgctcttcgtgaatttgacagcattgtttatgaagttcgtgatcacctgggttaaccggaaacggtctgcatatacctcgacgggaacttccggaacattttttataaactggatatgtgcagggatcaatagatgatgtgtctgataaatttcatctaccaggtcattcagtttgaatgtctcgaaagtgaaactcatacggcccgattcgatgcgtgatagttccaggatgtcgttgatcagtttcaatagcagattactgtttttgttgatcgtgtctttgaatacctctttttcttcttcagacagatccgtttcttcctgcaaaaggttcgagaagccgacaatggcattcaaaggtgttcgtatttcatgactcatattggccaggaaagccgatttcatcttattggcctcttctgctttctcctgcaggtcaatgagcttttgttccttttccttgaaagactgtatgttcaggcagagaccaatcacggcttgatccggttctgatttatcttctccgtgattgtaacgtaattcccaccaactgtatttttttccgctgaagttaaaacggcattgaatggtcgtttcttcccatatcccggagtttatatcccggatatgacaacttagatgctcctggtcgtccggatgtgttaaggataacaattcggcaagaggcatttcacgcggttgtatctgatttgccgtaaagaaatcattttcaaaaatgaacactccgttctccagtcgccaggcgtatgtatttccaccttccatagctaaacggaggaaacgccgttcttttatcagatttgtctgtaccagtcgtttccgtttggattcgcttctgtacaggtagaataattgagtaatgatgtagatgatcagaacaaggaagagaatagttccgataatcattgccttttgatatcgctcgtagaatggctggttataaataatactatctgccggcaggtcactcgtttttatattgaaacgcagcatttcatcccagtcgaacgcatatactttcgggctttccaccataggaaaggcagacggcttttttccgttgataatggcggcagctctttccgatacgatatcggtctgtatctccagtgtggtaaaatatccgcctgtaatacctttgccatcattgaacccgttattgatcacggtgaaattcggaacattggccaagcgtccgatggttaacacatcaaagtcgaggatgatttgcaggcaggcggtatatggtttactttgaaagatggccaataatccttttgcggaaaggtaagctgtttccgtggtgaataaaatagactttcccggttcaccgtggcagatatcttccggatattcatttttcttttgatgaaataggccgatccgtatggttctgcctgtgcctttcacttcctcctggatggtcttgaacgattctcttcccataaagcgtgcatgcttgaagaaaagtatatttgacgatccgtatagtttctctatcagttcaatggtcgttatataatccggtttatcccaaaatccgcagaaattcgggtgttgctccagtaaggagtaattcgggaagttcacaccggaaaagacaacaggcctgttttttcccagcgggtgattgcaagccatcagggtataagtagcctggtcgtcatttacaagtatgatatccgggttccaatgttttatcgagtcgagatactgatacatccttgcattctcctcagcctcattgtagcgttcgctatccagatagaatgtacggacatcggtattgatcttcttttgtttcagcttttctgaaaccaggttgctgaatttggagtaggtgacaagatcttttgtataggagtgtattaccaatactttgtataaaggctcatttgtatgtgcttttaatactcctacctctgtcatcgacatacataaaagaaggaaagtcagtatttgtataaaatttttcaagaagtatatcctgttaaatagctttaccctattctattagtttgcttatataatgcacagtgttatacatggccaaccggaccgaagtataacactgtgtttattctttctgtaattgcacgcaaagataattaaaaggtgaacaaaatcaacggttcttagggaatagttattttttttcaggataatccggatagagcagatatttttttcttgtctgtttgtaactgtccagttccggtttccagctttcccgtatttcttcttccgatagtcctctcacaatttggtatctgagctctttagtacctgccagtaaatcgaaccattggggacgtgagaagaagaaggcctggtcttttccggctttattatagaagtcgaggaagaagcgtaagctcaacccgccttcaaaaggatattcccgtagatctataccgtagcactctttgtttttttgcaaaggattggtatcgaacccgggaagcgacaccggagtaaaggagaagtccccgtacttcctgtccggaaaaccgattacctggaatgggtaataagtaccgcgtccgatactgatatttgtagcttcgaagaagcagagcgagggatagaggcggatcgactggtcgttaggcaggttaggagagggcttgaccggtaaccagtaaggatctccatgccgccagttctccatcttgacaatatgtagcttgcaactgtcgggtgaacttttcagccatccttcgctgtttatcatccaggccagttcgccaaccgtcaggccatgtaatataggaagaggatctacaccgacaaatgactcgaatccttttttgcggatcggtccgtctacgaaatcattcgggttggggcggtcgagcacgataaactctactccgttttcggcacaagcctccatcacataatgcatcgtgcttatgtaagtataaaagcggactcctacgtcctgtatgtcgaatacgatcacatccagtccttgcaattgttcggctgtcggctttttattttttccgtagatagatataatagggataccggtcttcaggtcgcggctgtctttaatatcggctccggcatctgcggtacctctgaaaccatgttcgggagcaaatactttttttacctggataccttgctccagtaaggcatccaacagatgcttctgctgtttctcgaggatagaagtttggttaacaaccagcccgacttgtttatcctgcaacaggcgggtcactacgtctaatcgttcggcaccgagtatcaagggagcctgtggagtagtcgcttgaatttcgggcaaaaacatcatgcttagtagccaaagtgtaagtctgaaaactgttttcataatctgtttcctaatatatcttggatgcaaaagtagcaaatgttcgcatcattaaagctatggaaagaattaaaagtgtttagatttaacatgtttcggatgaaccatccgcttctttgttctgttgaaatgacataaacattaataaataattatatggcaacgagattacctaaaatcaaggacaaagcaaagacagaagctctggtgttggatcgtaaagatgagcgttatccggtacagcaggtggctaccgacgggaaggttacaaagcaggaagtaaaagaagcggtacgagaaataaatcccgatgaagatagtctggggagccgtggatgattttgtttcatgctagtgaaacaactgtttcaccctgatggaacaactgtttcactagtatgaaacaaaattgtgacagggagaagcaagcactgatctcaagggaaatatttgaggatgtcaaagagtaaattatgtatctttgcgatctgaatgtaaagtgtaaataaaaatgaatcctcttgatattatttcaaagtattatccggcagagtcggatgcctggcatatcttagtaacacatagccgtagcgtgacagacaaagcgctgagtcttgcccgtctgcatccggaaatggaacttgatattccgtttatagaggaagcagccatgcttcacgacatcggtatattcctgtgtaatgcaccggagatagattgccacggttctgccgaatacatctgtcatggctatttaggagccgacctgatgcggaaagaaggtttcccgcgtcatgccttggtttgcgaacggcatacgggtacgggcatcacccaggaaatgatagaggaaagacatctgccgttgcctagtcgggtgatggtgccggtatcgttggaagaacagttgatctgcttcgccgataaattttacagtaagacgaaattagataaggagaagccggtcgagaaggtaaaacaaggtcttgtaaagtatggcgaggagaccgttatacgttttgataactggtgtaaactctttttaggggaataaaagcagaagggctcattaatttgttatacatttgcatgctgtaacggaccggttgaggctcaaccggcacttgtcaacttaattaatgaaatacagaggcttaattatcctattatatttcctcgccggggctttgatgatgtattcgcaggagctggttgccccgacggatactgtgttggctgttgttggggataccatagtccctgttgcgaccgacagtacagtcttagcttctgatactgttcccaagaagcagaccggcctggatgctcctgtggcttaccaggctaaagactctatcgtaatgactgcaggtaactgggcttatctgtacggtgaaggcgatgttaagtaccagcaaatcggactacaggcggaagtgatcgagatgaatatggacagcagtctggtattcgcgaagttcggcctcgattcgatcggtgacgagttcggttatcctttgttcaaggatggcgatcaggagtatgaatcgaagacgatgcgttataactttacgacccggaaaggatatatcaccgatgtgattacccagcaaggggaagggtatgtaactgccggtcgtacaaagaagatggacgacgatgtattgaacatggtaggcggtaaatatacgacttgcgatgaacacgatcatcctcacttctatattcagatgaccaaagcaaaggtccggcctaaaaagaatatcgttacaggtcctgtttatatggttattgaagacgtgccgctatatccgatcggattgcctttttgtttcttccctttctcgagtacttattcatccggtgtgattatgccgacgtatgccgacgactccaatcgtgggttcggtttgcgtgacgggggatattactttgccttaagcgattatatcgacctggctgttaccggtgagatatataccaaaggttcatgggggcttcaggcgcaatcctcttataggaaaagatacctgttctcgggtaatttcaatgccgcttaccaggtaacgaagtttggtgataaagggcttcccgactatagcttgaataaagacttccggttgaactggacacactcgcaagacccgaaagcaaatccgtaccgtactttctccgccagtgtgaatttctcgaccagtagtttcgaccgtaataaagcgaacggtttcttaaatgcgaataacacggatgctatctcgaatacaaaaggttcgagtataaatataacacaacgttttccgaataacccgctttctctttcggcgacaatgaatgtcaaccagtcatccagagattcgtccatcgcagtcaccttacctaacctgacgatcacattgagccgtatttttccgtttaagcgtaagaaccctgtcggaaaagaacgttggtatgaaaagatttcgatgagttattccggctatttcaagaatagcatcacaacaaaggaaaacttattgttcaagtcgaatcttatcaaggactggaagaactcgatggagcatagtattccggtcagtgctacttttacggcattcaagtatatcaatatatctccttcatttaattataaggaaagctggtataccagtaagatcacgaaacagttcgatccgggattgaatcgtttggttgaccgtgatacaacctacggattttatcgtatctacaattataacgcatctgtatctgcttcaacaaccttatatggtttctataaaccgcttccttttctgggagataaggtgcagatgatccgtcaccgctttgagccgtctgtcagcattagtgcagctcccgactttgggggaagtcttttcggcttctacgatcattaccagtatatcgatgcgaacggcgatccgatcgattatgtctattctcctttcgcacataacggttctatccctaatggaaagcagggtagcttgaactttacgttggataacaatgtcgaaatgaaaatcaaatccgatcgtgacactaccggtttccgaaagatcagcctgatcgataagctatcgttgggaatgagttataatatggctgccgactcctttaaatggagtgacctgtctgtcggtttacgtcttaagttctcgaaaagctataccttgaacctgaacggaacctttgatacctatacttacagagcggacagtaagggtaaccctgtcagggtagatataccacgttggaaagctggaaaaggtatcggccgtttacgtaataccggaaccagcttctcttataccttcaataacgatacctttaaaaaatggttcggaggtggaaccgacagtaacattccggaagaaaatatcggcgatggcgaactcgaagaccttacagctgagaatcccgatgatgccaacccaccggaagagaaggaaggcggtcgtctgcgtggaaagaagaaagataccggcgagtatgacccggatggctatctgatcactaagatcccatggagtttgtcattcaattacagtatgcagttgcgttacggagacttcgatcctagcaagttggagtataagtataaactgacgcatgcattgagttttaacggaaatatccaaccgaccaagaactggagttttaacttcaatgccacttacgacttcgacaataacaagatctcgttcatgacttgtaatgtcacccgtaatctgcactgtttccagatgtctgcaagttttgtaccggtagggccgtataaatcgtataccttctctatcgctgtaagttcttccctgttgaaagacctgaagtataaccagagcagtaatgtacgtgaaggacaaagctggtattaataaccgataagattagatataaaagaaaaggcgatgaatgatcttcatcgccttttcttttatattgcatagtctgttaccattcgataggtgtctggcctgtcgctatcaggtaatcatttgctttactgaaatgcttgtttccgaagaagccgcgataagccgaaaggggtgaagggtgtgctgacttcaatatcatattgcgtgaagcatcgatgaaagctcctttccgttgtgcgtatgatccccagaggatataaacgatatggctgcgttcttcggctagtttgtggataacggcgtcggtgaaagcctcccatcctctgttctggtgtgaaccggcctgatgtgcacgaaccgtcagagttgcgttcagtaatagcacgccctgatcagcccagcgcaacagatttccactgttgggcatcggtttgcccaggtcgctttctatttctttgaatatattgatcagcgaaggagggaaaggcgttccgtcctgcaccgagaaacaaagcccatgtgcttgtcccggttcgtgataaggatcctgtcccagtataaccacttttaccttttcaaaagggcaatgttcaaaagcattaaagatataaggtccgggaggatatacggctccctgacggtattcctgttttacaaagttgatcaactcattaaaataacttttctcaaattcaggagctaaccgttctttccagctttcttcgatctttacatccatagttttatattatatcaagtgcattcctgctgcacgggcttcctgacgcatttcttccggccagatacttgcctgtatctctccgatatgtgctttgcgcagatagaacatacacagacgactttgtccgataccaccaccgatactctggggcaattcgccgctcagtaggcgtttgtggaagtatagttctcttttttcttcggcgttagagatcttaagttgacgttccaaagcttctttatccacacggatacccatagacgataattcaagcgagcggttcaacacatcgtcccaaaccagcaaatcgccattcagtccggtctggccgttttcagccacagtcgaccagtcgtcgtagtccggggcacgtccgtcatgcttctctccgttgctcagtttacatcctataccgataataaatacggctccgtattccttgcaaatagcgtcttcccgttctttcggtgtaaaggtaggatatttttgcaataaatcctcggaatgaatgaaatgaatctgctgcggaagtgccggtcggatgttcgggaacatttcgtaaaccagatattcggtgcgaaccatagcggcataaatacgccgtacgatctctttcagatattcgatattgcgttcactggggctcataacccgttcccagtcccactggtctacatacagtgaatgtaggttacccagttcttcgtccgaacggatagcgttcatatcggtatatattccgtagccttcttcaatattatagtcggccagggtaagacgtttccatttggccagtgaatgtacaatttcggcttttgagtcgttcaggtctttgatcgggaaagtcacggcacgttcagtcccgttcaggtcatcgttgattcccatccctttaagaacgaacaaaggtgccgtaacacggcgcagccgtagttcggaagataagttttgctggaaaaagtctttgattttcttaatccccatttctgtctgggataggttaagcaaagctttgtatcctgcaggtttaattaaatagctcatatacttgttgtgctttgtgtttgtaaaatatgcgtggcaaagataattattaatggtaaaatagcaatgcagaagccttttttatttgcaaaatggcaggatatatggcaatgaagattgcaaaatatcaaaacatgtgttgtacagcagaaaaagaaagattgtaaaaactcttagccgctacatttgctttcctgcgatattatatttacttttgcatcgtctttggcctggtagcttagtgaatagagcgtcagattccggttctgaaggtcgagggtttgaatccctcccgggtcacaactgaaaaataagaagtcttataaactaaaggtttgtaggacttttttgttttctgttggaacgtattttggaacaaaatgtgttttttaatgaaaataggaatgctgatttatatttcgtaatcatccatatttaaataatcgtctggatcatcccaatgtgagatacctagtacttttcctgttttggaatcttccaataatacatacttatctccgtcgatgtgtattgtatccggaaatgatgctatcattgctttagctttatcaatattgaatacagggcattcgataatatcaaaacgttctatttccctttctagttgtttgagtagttcttccttatcgactttccagaacttcatttttttgtttgtaaacttaccaaatgagtaccaaaatttaaaagcactagccggacatgaattttgtggaccgattgcattaagtttacggcatccccaacccggacaacggttgttgacccagcagtgatgttctttgtcctctgaacgtgtgtattgaccgtaacagatggcaatagagcggttattcattaaacatttttccttttccagtaaatatatattcaagatttatattgtaccgctcgtatgccatgcgaatagcatacaagggtacattcattgtgttttcaatctccatacggtatatgttagaggatgcgaggccgacggactccgcaaattgtttttttgtttttattttccttaatccgatcagctggtacatgatagccaggaaccggtcggttataatcctgttttctgtaatcttctcgttcgctaacatattcttagtttttatataggagatataaagcattgcatctacttatagtatatattcaccttgatgagtaaatcctgcaacttttgttattgacttgtctagtgaatattttctttttattaggtatttagtattgtcttcttttttcttaacaacgtattcatgcgttatatcccaataagtagtaccgttgttaggggttttactttctatcaactcgctccaacttaaaggattgtaataaattggataataattcttggaatattcgattattacattttgtgctttttctaacctttgttctggagttagagtcatgatatcgatcgttttttcaacttctatggactcctttttttcgcatcctgcaaaaaggaacaataacagtaatgtatttagtattttaatcatcacatcacttctttttaatagccatgccttccacatagatataatcaaggtatataccgtcgtatattgcatgatatttaagaccaataatgccgtttgcacctttgctgacagcatctttatatatggcatctataccatctgtgtatgttgcccttctgcgattggatggaaatggattttctttcgacttgtgtttttttgcccactctttgtcctctccactatatataatagtatatacagatgctactggttcatagttgaatgatacggatgaagcttctgtcataaaaaatccttcttttgtgtattgactataatcaatacttcctgtttcaacataatagcttctagtgacacagctagataatgcaataatggtcagtaatagtaaaaatgttttcttcattttgtgaaatgtttaattagtgatttttatttaggcacttctatgtcatgttttttctcatattgttttacttattcttttgttgtttgaccacattgaatagttgcgctatatctctgaggtccaccgtgaagtctggataaatcggattgaaggaatgacaggtaattattcctttctcaacatcatggtcaacaatctgtttgagtacaataccatctgtcttatgtacgatgacgaatgcatcccatgcgttgatatgtaatttgcttttccagtaatcacaaccaatttctcgacaaagcaaaatgtccccttgctcatagctgtgcttcataccgtcatccatgctgtcacctctgacttcgaagctgatgtacttacctttatattctttgtcaacaatccacgggattttaggaagtgtttcaatgtaggctacgtcagcccaacccatcatatagccagcttgtgcatattggttgaccagcggaaccatcataagatattcgttttggatagggattgcttcttctttctgttcagttagcatattccctatgtctgctagtaaccaagatgcatttatattctcaattgagtgtattatgctctctaagaatttagcagaaggaacactttgtctacttcctaatatattgtttacgctagtgggcggttcatttatcgcttttgcgaattggtttttatttccgttaaatagcttatctacaatagtttgaattctttcctgtattgtcataactcaattgagtgttaaataatatcaatttcaagaaataaaatcctcaaaagagttatttgtaaaactcaattgagtatatttgcaatgtgattaacaacaaacaataatcacaatacaaagtaaatagcaaatataagaaaagtaaataacctgatatagtcaatttgataaaaaagtaaacgatatgagtaacaagattgaactaatgaaagcggaaattgaaactttagtaagcatgacagaagaagaagcatgcagagagtataacgttgatagcaaagtagaggctgttcagtacatcattgatttctgggtgtaggaaggaggtagccatgaatgaattaagagatattttaaagatggtacaagtggtacaatgtgaatgtttcggaacggaaatcacaatagcaatattcaccaaccagaaatatttttcagtccatgtacaacgtgccgatcgggattatgaggttgtctattcagacaaattctattcaactgaaacattggcaataaacacgaagaagtttgctggattgtatgcatttgttgtcgatgaaatttttggtattggatatacattgataggaaacaaatttgccaaagtagaaaaccgctgtgaagctggctaatgattgactaaaataaggttcagccgggtgagaatcccggcacacgggcggtcagtaatctgggatgaaacattacagagtgcgcacgatgtaaagaggctggttcgataccggcaccgtccacattgaaaacgatctttgacgtactacgagatatgatatgtaaccattaaggcgtgtaggcacgctggttacgagtaaataacccactaaatgagtctgcgatatgaaggagagaacaccaacctagagcaggcggtcacaagtatagcggagtaaacaaaattatttgacaatatattcatttttctgccaggcttgttaccgggttcgactcccggttgaccacatcaaatcaataataaattaattatgactacacaagaagcaattgaatttatccgtataaacaaacagtacggagataaaaaggccatatgtgaactagctggtgtatcacaccagacatttaatactatgatgaaacatgagaaaggccctgatgaagagaaatggtatgatgccgaatacaaagtattgtgtgaggctgtcgcatatctaaaaccaaaagttgttcaacgcaaaaagatggcggaggaacttaaaagaaaacttgcacagatatgattccgcttaccgcttcggaaactgatgcagtactttacctggccgaacatgaggttgtaaagattgctgccgataagcgctgtgtatcggaacataccgaaaaaaatcaaattaaatcggcaatggctaaactgggtgtaactacccagattggattgataaaagaattcttccggttgatatacggagttgaatttaacctaaaggatgcccggcaattaatggcttcatgtttactaatcctttttctttcaacattgagtggaacagaacagttaacatgccgagttaggagggtgagaaggaatgaagttgaattttatatggctgcgtgatgcaaataaatcaaataattcaaatgacgcaaagtgatttagagactgtagtatctggattgctgtcagaaaaggcaaaagcagaagtatatgagcgctattatagtgttttgatacctgcttcatgggtcgcaaaaattcacggtataagttatcagacagtattccggtatatccaacggggattgataacaccagaagaacgaaacagccgtgatgaacattatttatttcggttgtctgatgtattgaagatggattttaaactactgcaaaaacaactaaggaggaatactatatgaaactactattatcattcttattctttttcctgtctttcggatgcttatttcttgtgtgtaacgcagataaatgggaacctggaaatgtctttttctgggcgtgtgtatttggagtatcggtcgtcgtgacggaaaaacaattgaaggaaaaagagaatactaaataatattactaacaaattaattttcaagctatgagtttattcaaacaaccttccgaactggaagtttctacaacaatcaaagcgctgatctacggacagccaggtcttggtaagtcaacattaggtttgtctactccttctccggtattattggattttgatggaggtgtaaagcgtgtgaatggcgcttttcagtgtccgacgttacaggtgaaaaattgggacatggtgattgaggcattgcaggaagatttatctccatttaaaacaatcgttattgatactgccgggaagatgttggattttatgtctgtctatattattaaaaacgatccgaagatgggccagcgtgatggctccctttctttaaaaggctatggagttcgtaagacaatgtttatcaattttctttctcagtgttcaatgatgggaaagaatttgatttttgtcgcccatgaacgggaggagaaagatggagagaaccggattgtccgtccggagattggtggatcatctgcgggggacctgattaaagaactcgatttggttggttacatgcaagcgattggaagtgaacgcacgattagctggtcacctacagagaaattctatgcaaagaatacatgtaatctcccgcccatgcagaagataccaatcattattgatgcttctggcaatgttaccggacaaaacattttcttatcaagtatattcgatagctatcagacttatttaaaaaaacaggcagatatcagtaatgattatgaggctttgattgatgttgtaaaggaaaatgtagaattgattgttgatgctgataccgctaacggtgtcactgaaaacatgggaaagctacaacatatttgggatagcaaactgaaagccggtctgatgatccgggataaatgtaatagcctgggattaaagttgaataaattaactaagaagtatgaatcagccgatgccgcagcaacagcctaagtataaattctacccgtctcttttagatcagtttgaaaagtatctgcatgttgatcgtgagtttgagagttttttcaatcgagacaaagagacagatgagtataaaaagacgtatgaagagatagagactgaaatgaaacagtctctacttgacagtattaaccgggttccgttcgattcagaacccgcggataagggtacagcattcaatgatattgttgattactttatccacaacaagcctgtcaaaactcagatagtggaagatatcaatagtgatacaattacagcgacatacaacaacagaacgtttttattttcatatcacttctgttgtaaagctgctgaatactttcatggatcagttagtcagttgtttgttaaagccgttcttcctacaaaatacgggaccgtagagttgtacgggtatattgatgaactgaaccgaaatagggtgtacgatattaagacaacttcccggtatgagtttggaaagtactcagaaggttggcaacgacatgtgtatccttattgccttatctcttccggactagtcaaagacattgattcttttgaatacaccgcttatcatttgaaaggaggtacaagccggacaccactcattaccggtgctcaatttccggaactttataaatatgaccacgaacagagccgaacactattaacccggcattgtgaaaggtttattgaatttctcgaattgaaccgggaactaatcactgataaaaagatttttgctgaaatatgaaaacacgatttgtcaaggaacaaggagtaatcaagtggctaggtcagccgatcgagcttctctttaatcttgttgtcaacggtgaatatacgcttgaaataaagaaaaaagtaaagaaacgcactgttgaccaaaacgccctcatgtggatgtggcttacttgtatagaagatgaaacaggtacactgaaacaagatgtatatgaatattactgtaaaaagttcctttggcgaaatgtattcattaatggtaaagaggaaattgtcgtccggactacatcgaaacttaatacggctgaaatgactgtatttctcaacaaagtacaggcggatgccgctagcgaattcggtataagattaccgtctccggacgatcaatatttcaactcatttacaaacaggtatgaacatataaggtattaggatggaaaaacaggttaagattgggaatctcgcccatgaacatgagagtgaaaccgctaaacagactttgattaaatcagtaaaagccactgaaagaaggttgttgaaagcgaagaaattaatccggttagtgattggttcagcaatagtaatgaccacatgcccggaaaagtataacacattaattcgttgatagtatggaagaaagagaacctaaaattaaaaaggccgttttgaatggtcgtcagttgacagtaacttatacggagttccgtccggagggtgacaaggatattgttgttaagtctgagataccggcacatattgattgtacaaatgctttcaagaaactgattcctcattttattcttctcacagaaatgaaagaatccgataaagtaagtgagcgagctgcgattgttggaatggataatctgactggtgacgacgatgattttaagaatgctgatgtttacggtatcaaaatgggaaagaatgatagtagtaccgatacggtcattttgatgggtgaacggtatcttcaaattggtggttcagttgatttcagttctcctgctcaggcgttggaatcatcggatagtgaatttgaatatccttacattaatgaattgaacctggctgtacaggcagtgatttatgaagtaaaagaatatttgttcaatcaaaaatttgctataactcaaacgacgctagactttgaagcagtaccggacgctccgtttgaagccggaaaaatggtagatacggataccggagtagttactccgatcactgttgagaaaccgaagcgaggacgtaaaccgaaaaatcaacctcttgcaacagcagcagcatgttaatccaagaagacgaaaagaattatttcctgcaatttaagtatcatccgcttatgattgatgttgtcaaacgtattcctggacggaagtttgacagcaaactaaatatgtgggtgatacctaaaagtttttatccacctggaaaatatactcaaaaggcctatgtcgacatttttgctaactgggctgtgaaaaaaggctatgagaaaagcgtacaaaaaggagctcaggcttcaagaccggacgttcactatacgcttcctccgatgctggaattactttcaccgcatgggctaaagatagagcctttcccatatcagaaacaaggtattgcctatgctttacagaaaaagaggtgttttttcggggatcaacctggtttaggaaagacattgcaggctatcggtacatcttttatagcaaaaacatggccggtattggtgatctgtcccgccagtctaaagatcaactggcaacgggaatggaagaaattcactggaaaagatgcgattatccttgatgatcggaataaaaacaactggcaccggtattacgaaatggggtgctgtgatgttttcattacgaattatgaatcattgaaaaagttttttgttgaagactttgccggtggtgtaacccggtcgattaagctaaagccggtagccagtttgtttaagtgtgtgatcattgatgaaagccaccgatgtaagtcaagtaagacacagcaatcaaagatttgttacaagttatgccagggaaaggaatatcgtttcctgctcactggaacaccttcgatcaatggtccgggtgacctgatccagcaattaaagattatgaatcgtttggatgattttggaggatataagagttttgaagcaaactttatgcaggggccacggcaggcaagtaatttggagatgctaaactggcgattatggaataccggtttcttccggagggagaaagcaaaggttttggatcagctgccggataagatgcgtcaggtcgtgaatgtggatatcacaaacagaaaagaatatcaggatgcagaacatgatctgcttagttatctggctgcttatgaaaatgctgatgatgaaaagttacgacgggccgaacgtggtaaagtgatggtacaaatgcagaaactccgacaaattgcagctagaggaaaaatatcggcagccgtagagtttatccaggacataattgattccggtgaaaaattgattgtttttgcctttcttaaagaggttgtacaggagataaagaaagtattccctaatgcagttaccatcgttggagacaataccagccaggaacgacaggatgccgttgatcggtttcagaatgatccgaaatgtaaccttatcatctgtaattataaatcggcaggggtaggtcttacattgacagctagtagccgtgttgcctttgttgagttcccgtggacgtttgccgactgcgagcaggcggaagatagagcgcatcgtatcggtcaaaagaatagtgtgaattgttattacttccttggaaaaaatacaattgatgaatcgatatgggatattattcagacaaagaaagacatagcaaacgatgtaaccgggacagatgatcaggtaccggagaaaactgtcgatgcaatgattttgaaaatgtctgctaaatcaggaatcaagaaaagtgaaacaagcacgtctccgttcgatcgtcgtctggatggtgcactattcagcaatgcaatatgaaaggtgaggcaggtctgcaatcttcatgtatagagtggttcaatctacaatttccaaaattgaaactgcttcttttcgctgttccgaacggtggccggcgtaacaagatagaagcggccaatctcaaaaggcagggtgtccgggctggtgttgctgatcttattttactttttccaaaaggtggtcacggtagcctttgcatagagatgaagtataagaaaggtacgcagcaggattcgcagaaggactggcagagggtagcggaggcggcaggcaataaatacgttgtctgccggtcattgaatgagtttatgaaagaggtcaagaactatttaggtattgagcgatgaattatattgaattaataaatcggttttgggaattggatgagcaatggcaattctcctgctgtgaaacgagactgtatttttacttggtaaaaacagcaaatcgtttaggctgggtggataactggacgcattcggatgatagaacatctgcaaatgtgggagtgtcattgaatacaatgaaaacagccaggaaccggttatctcagattggtttgattaaatttatttccggtggaaaaggtcaaaaagataaaacaaggtatcaaattttgacacctaacttaatacctaacttgacacctaacttaacacctaatctgatacctaaccagacccctataaataaactaaataaaacaagtaataatataccccctataatcccccatgaaaacaatttgccttttccggaagaaaagccgaaaaagaaatccagtagggcaaagaaagaatttattcctccagtactggacgatgtattaaaattcttttccggcagcttattgcctgattgggagaaccagggacggttatttttctctcattacaattcccagggctggcgtaaaggaaccggcgtacaggttactgactgggatagtttagcaaacaaatggattttagacgaaaaaattaaacgagatgcaaggagtacaggaagtaagacaaacaatccagcgtccggtaacggatacgccggaaaataagattgacctaacggcctataagaaattgtttcttcgggtagcagatcactattccaaaggcacatttgtaatcgacgagcgaaacagagcgatcgtgtattccctgtttctgtatttcctgaaacaaccgggatcgctcgatatccaaaaaggtttgtggttagccggtccggtcggtaccgggaaatctacgttgatgtatattttcagcaggtttatgcaaactttacaaagggggttccgagtgtatgtgtgtagccggattacgacagaatatacaatgcacggagatttgagccggtatctggataatgccggatggtcttcattgggcccggttgatatgtgtttcgacgagttcggccgtgaaccgatcccggcaaaatatttcgggaatgagttgaatgtgatgcagcatatatttcacattcggtacagctattggcaacagtacggattgagaacttatgtcacaacgaacctgtaccctaaagacgtcgagcgcaaatacggtgattatatccgtgatcgacgtggtgaaatgttcaacctgattgagttgaacggagaaagtagaagataactaaactaaaaaataatatcctatgagaacaaaaagctttaatgaagtaatcgctgattatttgaaacagcgggcagcagaggacacactattcgctccgaagtttacaaacccaaagaagagcgttgatgaatgttgccgctatattttaggtgaagcgcggaagcgcggtaatgaggtggtaatgactgataatgaagtgttcggcttagctatacactattacgaagaggaaaatatcaaagtgaatgctagaataggtaattcagttaaaagccgggttgtaagtagcaaacaggttcctgaggttcaaactgtggaacagttgtcgatacaatatgaacggcctgttttttccactgttaagcgggggagaggtaagagagaagaaagcaaattacaattatctttatttgattaagccatgaagccaaaaacaaaattacaaaagctggtagttaaactgagcgcacaattaccgaaatttactgagaaacatcgtcaatgggctattgaaaatgtcgttgatcgtattggtcttcgattgaaaaaaggtattattacttgtactcattgtagtgaagtttttcctgatacaatgaaatttgaagatggcgaaattgatatctgtcctaattgtggaagtaaattgaagatcgaaacaactacgaggaaaaatgattttcaagcagagtatttctgtatcataacaacatgccagggatttcaagtattccgttattttatgattaagaaggaattcaaatttggttgtgaggcacaatataaaattgcggaagttgtccagcgatggctcctgcctgatggtagatttgaaacatttgcaaaacttactaatacacatcaatattataatgatgcgtggtgttttgatagtgatatggaattgagaggtagagataaacatgcctacaatgttggatgcgacgcatgttatccagttcgaaaatatctttctgtttggagaaagtacggattcaaaggtaaaatgtatggctttttcccttttaacttctttcatctgatcagtacaaataaccaagctgaaacattacttaaagcctgtcagtttgatttgctccgtagaatgtgtgcagggtatgatgatgaaataaaaagatactggccatcgataaaaatatgtatgcgtaatcattatcttgtgaaagatgcaaaaatgtggcttgattatttgatgttactcagttactacaaaaaggatctacgcaatgctcactatgtctgtcctgttaatttaagaaatgctcatgatgagtatatgaataagcggaatcgcgaattgactaaagaacgagctgcctttgatcgtgaaaaagctatttatgcagaacaacgacggaaacgactttttgaaaagatgaaggaagacaatctcaaatatcaagaacagaaaggtaaattctttgatgttcaattcaatgatggtgttgtagtggtacgtgtactacgtagtgttgaagagtttaaagaagaaggggatgctttgaatcactgtgtatttacaaatgagtattataaaaagactaattcccttgttctttccgctcgaattggagataaacacattgagacaatcgaaataaatttaacgactatgacggtcaatcaatgttatgggcatggaaataataatacaaagtatcataatcagatacttgaacttgtgaaaaagaatatgaacctgatccgtcgaaggttgacggcgtaaatattaagttgttatgaaatatgttcctgtttttggtagaaatattgacagctatattcaaaaaagattgaataacaaaactcatttgatttgcacattcgatagagaagacggtttaaaattgtatatactagcaatagaaataaatatgagacttgaagataactcccttatgccctggggaaaatataagggtgagaaaatggcaaatgttccggctacatacttgatgtggctatacaacaatgagaaatgtaatgcggaagtccaggcgtacattgaagataacatggatgctttaaaagaagaaatcaggcaattaggagataaaaaagatgaaactaaaagatatagcaagccaattggctaaccgaataaaccaaccagccgtaatcgaagtgtatcttcgacaggtatatgcgaagggttttatagatggtaccaaacagtctccctggataagcgttaaggaagggttaccatgtgatcaaaatatcgtcttggtaaggagccaatatggaagcaaatctacagcttattattgcgacaataatatcgggtttgtaatttacggagaaaatgcctataaggtttttggagtagtaacgcattggatgccgataccggaattagaagaggactgaacttttgctcaccttatttgcaaggcgaacaaacgcgaaaaaattgaaaattaagtgttaagtcgacattaaaatgaacataaatgtattatcttctttacaaagatatttcatgtagtatataatgttggcaacttatacaaataatatttaaaaagtgaaccgtgccggattcgaaccggcgacctctgccctgtcaaggcagcgctctaaaccagctgagctaacggttcggtttagcaaatataagaaaagttataaaatagtagatatggaaacaaatgagaatttcaatttatggtgtattgtcgaattattcggacataaccggatagcaggcaaatgtagtgaacaaagcatagcagggaataatttcctccgggtagatgttccggaaacgaaaatgcagccagcatttactcggttcctgaatcatgctgccatctatgctattaatccaatcacagaagaagtagcgcgggatcgggcagaagtttataattgtgctcctattgatagatgggatgcgaggtctatgcttgaaaaaattcaggcagaaataaataatgacagaaagacgattgattctcctgctgacaatgataaggatgattatcttgtattttaatttaaaaatgagtaaaccatgaagataatagtcagtttctctggcggtaaggatagccaagcttgcctgatccaagccgcaaaccgatacggagcagataagatagaagccgttttttgcgatacaggctgggaacatccggatacataccagcatataacaaatgtttgtcagcagatgagtatcaaattaactacactcaaacctgaattaggctttgtggaattagcaaagaaaaagaaacgtttcccctcggttatcgggcgattttgcactatcgaactaaagataaaacctatgattgattatcttctctccttaaaagagagctgtattatcattcaagggattagagcacgtgaaagttctgttcgtgctgctatggaaccggaatgtatgtacttccgatcctacttccagccgaatggaagtggcagaaaggaaacatatcggggcaaagaagttagggagtggtgttctaaatatgatgcttctgttattcgtcctatattcaactggtctgcccaggaagtaattgactgtattctaaatgctgaacagaagcctaatccactttattacaaaggtttttctcgcgttggctgttttccttgtgttatgtgtcggcaagtagagattagggagttactaaaagatgagcttatgaaacaacgattgattgatgctgaaaagtatgtaggcagatcgttttttgcgattgatactattcctaaacggttttgcaaaaatggagtgtacgcgatggcagaggaagttttcaagtatgtttctgacaaaaatgccacattggatatgtttgggccagagggtggatacgcgtgtatgtcaatctttcatggactttgtgaataatgctttaatggtagtaaatataagaggcagagtttacccagcctcttatattgcctcgacataaggactttcataattaccttttagtccatgtctttccatatatgatctaatttcacttctataagcgatttcaaaaatgtatccatctttaggtgatgggccaagcgatctgtcgaatttgtaataatcgccattgtgataaaaagaaatacgatagtttgccataatgtgcagtattttaattttgttatctcggtgtgttgataatagtgaaaatttatttatgattgcagtttgggttaaagctcctaaattcatcgagcattgttgacaagcaatcattttctttaataaaatctataagatagtcttctgtaataataaattgtctatttgtttctttttcttttgttgctaatatttgctctccgtttgatgttatctgaaaaccatgaataattcgattcctcttatcacatagttcttcaaataaattagctattttatcatctgaattttctgtaattgtatttttgattgcaaatttcatcatcttagatcctgatgttgtatcaattaaatcataccaatcatattgatgttttcctttattatttagaatattttcaatgacaaaagcattatttgaattgaaaacacatagagcaattcccaacaattttatgtattcttctgacggtaaagcctgttttgtaattgattcgttcatttttatttgtatataatttataaataggtcgtttaaaaattcccccatatagcagggtttgttataatattggcaataacatttgaagcaacatcagaaccaaaacttttaatcttatctataagtctatttttagcttgtacaggatcagattcattttctatgattgctttaatctctttttgttgtttgcctgttaactcatcttttattgcttcaatgaagatgtcaatagctaaagactgttcttgagattgttcttgagattgattaacattgacatgtatagaattgtctgtcttattattctcattttgaacttttgggagttctgggataacaagacatgattccaatattcctagtaatttgtcaaataaactaggtgaattataggatttagtaaaatcttcagcagctttttcaaaatcattaatacatctgtctcctgtaaatttgaaagataaaaacctgatagtcttatttttccaaatttcatattctgatatactttttagattataagcgtcaaaagtcctccattcattttctaatgtaggtatataagaaatccccttcctaattttgttaccttcttctataaggtcttcgagagttattgtagccatataatattattgtatgaatttccaaaggtataaattaatttgatgtgatgatatttaaggaaccataaacttaacagttgtgttttgtaaatatcataatgattatatattattcaatatgatatttttattatatttgtctttacataaatctgtatgtatgagtaatataaagattgatcgaaataactatcgtatccatgatgacaagaacaaacgtctgatccggaaaagccttgaagaatgtggtgccgggcgttctatcctttttgataatgatgattgtatcattgctggaaatggtgtatatgagcaggcccaggagctaggtttaaaagtccgtgttattgaaagtgatggtacggaacttattgcgatcaaacgtaaagacttatcgacagaagatgcccggcgtaaggcattagctttagcggataaccatacatctgatacatcattctttgattttgatgctatcgtaaaagattttggcgttgatgaactggaagcatgggaattagagataaatgaggctaaagattattccgataaaaacagagaaattgatgtagaagaatgggaagacgcgcatgaactgatattgaagtttgatgctgaaacttatttacgagttaaagagtcattaatgactattgactctgatcccagtaaggccgtatgtaaattactttttgaaaatgtcaatgatgaaattacaatttgagtggtatataaagaacggttatccctttaaagggatggaacctcacaggctgaaggtctttggcacttttatttgtggaggtggctcatctatgggatataaactggccggctatgaccatctcggaggggttgaattagatcaacaggtgtcaagagtatataacaggaatcattctccaaagtacttatatacagaagatattcgactgttcaatgaaagagaagatttacctaacgaattgtataatttggatattctggatggttcaccaccttgttctacattttccatggccggggaaagggaaaacgcatggggtaaaaagaagcgcttcaaggaaggtcaggcaatgcagcgcctggatgatcttgttttcatttacattgatacgatctgcaagttacgaccaaaggttgctatactggaaaatgtaaaaggaataatacagggtaatgcccgcgcctattcaaaggagatcgtaaaacgtgtgcagaagataggatatgatgtgcaggtcttccttcttaattctgcaagtatgggcattcctcaaaaacgcgaacgtgtattttttatctgtagaaggaaagatcttggcttttcaaagttgtggctaagctttaatgaaacacctatcctgtttagagaaatcatggataagaacgatcagtcagacaatcttaccgaataccaaagaatgttatggaataacaaacggaaatctgataaatcatttggagatgtaatagatcggctagaaaagcgccttagtatgttttctaaccctattattcattcagatgatgtggcgcctacattaacaagcggggccggtgtgaatgctctttatgatatccctagaagtctaaacaaaagagaaatgtgtctcattggctcatatcctttagattatgactttgccgatattaaacctgaatatttgataggtatgagtgttcctcctattatgacagctcgtatctcttatgagatatataagcaatggttttgtaagaagagtaatagtttaacaatataggtttaacaaatggcagcaacaagaaaagcaggagaaaaagagcaggacaaacagttgattgcccctctttactttaaagcgtatacattccgtgagattgcggagtctgtatctgccattactggccgtacgatttcccatgtaacagtattcaatgatgttaaggagatactgaaagagtctgaggaggcccggaaggattttgttaataatcaattgacaatagaactcgggaaaatcaacaagctggaacgcgagtattgggaagcctgggagaaatcaaagacggaccagaaaaagaagtctgttgagaagaaagatgattgtgagggtgatccggcaaaaggtaaaaagaaatcttctacccgtgttctgggagaggaaattatcaacatgggcgatccgcgttatctggccggtatcgaacgatgtattgaaatgcgttgtaaacttcttggaataaacggaactcaaaaagttgatgtgacaacgggcggtaataagatacagtttaccggtttcaatttcctgccggtgacaccgaacgtagaacagctaataaagcaagctgatgaatgaagataaatttaaaacagcggcttgcctacaactatctagcggatagtgaacataaattcatcctgtacggcggtgcgggaggtggtggaaaatcttggttagggtgtgaatggttgatgcaatgtgcctttcatttgcctggtacacgctggtttgttggtcgtaacaatctaaaggactcacaggcttcagtatcggtaacgtttagtaaagttgcaaaatatcacgggtttaccggttaccgtgtcacaaacgacggaatcaagttcgataacggttcggagatcgtttatctggatttgacttattatccatataaagacccaatgtatgaacggttaggatcgaaagagtttaccgggggatggatagaggaagccggagagatcaacggtctggcttttgaagtgttgaaaactcgtacaggtcgacacctgaatgatgtctataatatcccgtcgaaaatactgataacctgtaacccgaaaaagaactggttatacaagactttttataagccttggaaagacggtaagatcaaagcaccgtatgcattcataccggcattagtacaagataacccgtttgtaacagaggactatgttgatacccttcgtcagacagaggacaaagtaacgtatcaacgtctttatctgggtaactgggagtatgacggtgatccgaactctctagttgattacgatgcagtgatggattgctttaccaataccggtgcattgatcggcgggaaggctataagtgccgacctggcaatgaaaggacgagatcactttgtcgcgggttactgggaaggcttacgggtttcaatcgagattgataaagacaaatcatctggtcgggagattgaaacagatttgagaaagctcatggttacgcgtggtgtcggcaggtcccagacagttgcagacagtgatggtttgggaagttatctggagagctatctaaacgggatcaaagagtttaagaatggtgcatctgcattcaataataaatatgcgaacctgaaagccgaatgtgcatacaagttagctgagatgatagacaaacggcagttgcagatcatttgccgaccggatcaggcggaacacattgctgaagaactacagctgttgattgcagcgaatgtagataaggatacccggaaaaaggatatcatcagcaaggaagcaatgaagggtataataaagcggtctccggactatttagatatgctgataatgggaatgtatagacttgttgccccgcgtacgggtaactcaatatataactggtaatgaagataacgagtaagactactattgaagatgtgattctgatgctaaaaggtattgacttttgggatcagctggagactgtatttattccggtgaaaataccagaactgacatacggccaacgtattgacttatcctccatgaatacaaggtatgaccttctgtttattcctcaaaaagtattgttagggttagaagagaaggaagtgatgagtaaaccttttatctctgtctacaactatggtctgtctgtttaccgggaactggaacgtatgagaatccgtgacgaaaaaacattcaaatataatccgacggcggaagaagtaaaagcaggattttatggaatcgatcacggtgtttttggcgttgtcgatcggattgcccaacgtctgtctatttctcatgaagcagtattcgatttgccggagagacggatatatgcaatgatgaagatcgactatgataacggaatgtatcaaaggaggttgaaccaaataataagtaaacagaaatgacagtacaggataaattgaaacaggttgctgaatcactaggagtaccgttcgtttttgaggattggaccctggctaatgtggagattgacaggacaccacttccggccgtcgtgtatgttcttcctgcttccggggaactggactttaagaatggaaatatccgtgacaaccagaacgggatgctggcattcttagataaagtcgagttgaatggtaatggccaggacaatgacagtgttgttgatcggatgaaatcattagccatgagatttattgtgaagttgaacgaaacgggatactttgaacctttgggtggagtgatgaagtaccaggttgcatataataaactcaatgcagtgacatcaggcattgtctttgaagtgacattgaaagagataaccggaatatgtgaacgtaatctatgaaagaagtacagaacataatatttgaagaattggaggatcttcggaaacgaataatatctaatattgacagtaccgggcgtaaagcttctggtcgtacttctggctccatgcatacagatgtttcagagaatcgcgggatattgttcgggcgtatggcttttgaaacattagagactggacgtaagccgggtaaggttccggcaggattttatcagatcataaagcagtgggtaattgataaaggtatctctttcgatagccagtcagagcgcaattcttttgcttatttggtttcccgtaaaatagccagggaaggaacacaactttgccgtacgggcgccgaagccgatgtatatacaacagaggttccagatacaattgaacgcataaaggatcgtgtcggcttcttgatgagattggagtttgaatctataaaattgaacaaataatatggcaacagtaaacgcaccaacggatacgcagtatgtttttgatccggttcttttcataatggaaggagcaggggagtatgatatcactattgaaggggtgaagacaaaagtgtctgcaatagctaacactgctgtgtttgatgcatcaggacttttaaagtccttgttcactattgatacgttgtcaaatgggatggtacggaagaatgttgcctggtccgtggtgcaagccggtgtatctctcgcttccggaatctttgaagttgtctatggaagcaataaggttgtcaatttctccggagacggggcacatatcacattacgctggattagccgtagcggtgagttagattcatacgaattctgtattcatcaggacagccggaaattagagaatattcaaacggccggtatcggaggattgacttataaattatcattcagccaggttaataaaataactctgttcacagctttggtgaaccgggaaacatttgaagactttacggccattcaggaaagtgctattgtacaggcctctgttcttgatgggtggttgaatgtagaggttgaagcaaaagagtataaacgaacaaaagccgcattgcaggattttgatataacaatagtgttaccgaatgaaagataaactattcattgataatgtagaggttgatttaccggaaggtggatcgggtgtcgtattgaatcgtgcagtgagtaagcctgctgatatgtcaacgatattgtcgggatattcttatactatccagcttcctaaaacagcacataacattcagacgtttggtttctcaacggaggtgaatgtagaaagtgactacccacatgtagaacacacagcaaaagtaatcagggatggtatcactctgtttgatgatggtgttgcagtcgttaaatctgccagtaaaacaattgaagttctgatcaaattcggaggaaataaacggttgacaagtctcaatgattacaagctaaaagatatttttccggatagtggtttgattccttgggactatagtgtgaccgaaacggattttgtaaaatgggttccaaagttagacggaatgcaaagacagcatcccgaacatttacggccagcagttaaagtgtctacattattcgatatgattgttgggcagtcgtttgtcatgaataacgcttatcgatctgtgatcgaaaaaatgtggttgatgttacctacaacaaatgggagtgaggacgttgcaaagaatctggctttccgtctcaaggggacaacaacatctgatctgatctccggtagggaacgttatgatattctacctgatttgagttaccaaaatgctccttatcatcagaaactgcatgaccttatatatcgcacattgcctgtaacctttattaaaattccattaggtggacgatatcggataaaaggtacagtaaaagcgaataatgctgcaactgggtggaagttcggtatattcactccttctgttgagtttaaggaaggtgagcctcctatgttcgatatatttgaaagtgcatcaaaagatattgatgagtatagaaacattggtgcaggtgatatttgttttggtatttacgatccttttaagactgggaattttgaaatagatttgactatctcttttgctccggagaatgaaaaggattattcccagacagcattcttattggattatcctatacgggagaaccttccggatatatcgacgatggactttataaagtctgtcatgggggtgtttggcttgatggttgaacagcagggaagtgttttatcattctacaatgtggatgatgtaatcctgaataaatccggagcgattaatatttcaaaaatgcttatcgataaaaaagatgataagctggaatattcctatggattgactaaaaagaatatgctgaaatatgcagaagatgatttggttgataaattgttcggagcatatacgtttacagcagacacgtacgataagcaggagaatacggtatatcagtctccttatgctgctactaacaaaaacattcctctatatacttataaagttgaagaagggaaagcagaatatactttgaataaaacgtcaaagtgccggttattgttggagaatgggaccgttgcgctagaagtttgggggaaatggatagatgcagatatgaaaactgtcactttccgttcatttacttttgaacctttgaaatatgacaacctggtccgtagatattggacggggtatttaggtgtttacgcaaataaaccgagaatttcatatcgaaaggcgaaacttgatccgacctttttcccgaatctatctttttgtaaaccattgtatgcagatggtaattattacatgttgctatcggtaaataactatacagaagttggtaaagctgatttagaactggctctcattgatggggtagatgtaacgggggaaggtgaaacctctttgagaaacgccatattggtaaatccgacaacaccgttgaaattttcacctactacggtcgctctttatacggcaatgtctttggctgttgcaacatctactgatggaaagctgattcgtgaattagacgaaaccgggacggtgacaaatgatatgtatttgccattggatacaggagagggggatgctaaaagagttgctttaaaaactatcaaggataatattcagagtgacagtgaaggaatattccttcgtaaagacaagccggattcaactgagtttccgatcgcctttaaaggaggcgctacctttggcaattatgtaggcggctttcatggctccggtgccaggataaatgaaaaaggggaaggcgaaatgcgtagccttcaactatgggagttcttggaagtacctgaactacggtttaaccgtatcgacgttgtttcgggtgaactttggaatgccatagctttcggtttgatcgagtctgtcgatacagagaataagatcgtgaaattgaagctggaagagggcgaacttgccggattacatgtgaatgatttttgtcgtggcatatttcataacctgaccggaaatgagacaacggaaggaaccgacagtgccggatttaagacaatggttggtttctcgactgcttattttactccggtagagatcatagataatgctcatttcagatatgaactgaaacccggtacaacgattcatcccagcatggctatgaagtttgccgtgtacggtcatcctactgataagaaccggcagaattccgcttattcaacaaggatttatcagcgatatcttcgtaatgtcagcacgtgggagattaatccagggaaacatatttcgtcgcaatggggtgatctttccgaccttatcataaatggagagtccctagccgaaggatcaatctatttgaacaatgtttatttcggaggaaacgtttggaacgttcctggcttggataacaatttgaagggacaggatgcatattctgtaaccttgtcgacttatagtgctgtatataatacgaaagatggattgactgaacaggttgatatcgttaccggtgataaaaatgttgtgacgggaatgagtcaggttgttgcacaaaactttcgtatatcaaccaaaattcaggtaacaaaaggtacggagttattacggtacagtactgttattggagaaggtaaatatctggtttcctctgtgggtacaggatgcacatatacagtaaccgatggccttgtcgtagttcatagcgtaacggaggaaaaggcagaaataaagttggagattaattgtgagggactagctgtctatgaacaggcatttacaattgtccgggtaatagatggtgtggatggtacagatgtggaatggatatttcagcgtaccgcaaccgaagccgcgaaaccggccagaccgactgtctctgaaaatgtggcggattttgttcctgagggttggacagacgatccggtaggtccagatataacgaatcagtttgagtggagttgtaagcgtgaaaaagcgaatggtgtttggggatcattctccgaagtattcctatggtccagatggggtaaagatggtactagtaccgaatacatctatgccctttcaaagaattatgcgccaccagcgataactaacagccaggaagatggccatgtccctatggaatggtattctgcccctcttagcgttaccgcagagtataaagtattatgggtgtctcaacgggtaaaaaaagatgggcgatggagtaatttttctaatcccagtatatacgcaaaatgggcggaagatggaaaagatggagatcctggtatagatggttattccacatatggagtttatagaaggtcagagacgcaaccggacactcctgaggaagataaattgcctccttctggttgggcacgggatcctccttctggaacccttccgctctggatgagtaaggctgtattttttagcagtggttttaaaaaggggccttggtctgctcctgtaagaatatcgggaacagacggtcaagatggaggagccggtccttcattgacattcagaaaaaaatatgatgcttcgaaaatctataccgggacggaacaacatgttgatgctgtttatactgaagatactccagggactaaagtcttttggatggctaaaacgtctgccggttcatttagtaataaatatccgagtgccgggtctgcatattgggaaagatttcaaggtcaatttgaaagtatagcgacgggactggcattgatcgaagaggcaaatattgcaggttggtggttctctgacctgacaatccagagtcaaaataggaatgtggttattgacggcaatgccgatactcatccccgtatagcgttgggggcctcgtatgagaatagggataatgcaccggcaagaatgtatgaaaatggtgaagtttattttgagaagggtacttttggaggtaaggtcataagttcacttaatggcaataggattattattgatccggacgatcagtctctaaagatgataaattcatcaaataaagaagtttttaatatttcatttcagaatacagtaggacaacaatcgtttccagaaataaacatgtatatgcacactgtcgatggtggtttagcgcgacatataaaattacacgcaggaggactttatatgctggggagtgacagttctaatacagtatcaataacaccatcttctttgacatttccaaatctatcatcgattgatcccaaaatcaaaggagctttttggagggatggaacaaccgtaaaggtttcgcaaggataacactattaaattataagtaatatggcaggaacaaaagatataaaagatttcacaaagtttcccagtttatcggacaatgattatctgttgggaacaaagaccgatttaggtggtacggatgccggtataactgtcgggaacttcaaaaagcaggtggccaatgatgcggccccttcaattaatgaaaatggatactgggtcgttaatggtgttagcacaggagagaaagcccggggagaaactccggtgttaaacagcggtacgacgaccacaggggaggaaggaaccggagcatcgtccgaagtcgtacctgacgggcagacaccggagggatcgcctaaatacaagctaaacctgacccttccgcgtggatcggccggtaaggctggtaaaacagcaatcttcggaatagggaatgtctctgatggcgaaaaggcctctgctaccttgactgctgatggagaagacggatccggtaatcccaagtataaattgaatcttgtgttacctgcaggtaaaaccggagaaaacggaaaaactccgaagttcgaagccgggagtgtctcgacactggaaccgggccagttggcctcggctgaaataagcttcaaagagtacgatatggacggtagcccaatatacgtaatttctttgtctatcccgaaaggagatacaggtagtcccggtaaaaccccggttcttaaatcagtcaatgccaaatccggagacactccttccggcagtttcatcgctgatggtacagatgaatccggtaacccgaagtatatcctgaatcttacattacctgccggaaaagacggacaaccggcaatatttgaacagggaacgacgactacattggaaccgacagaaccggcctctgtagaagttgttgagaatgggacaactccggaaggaaatcccaagtatatcctgaactttagtattcccagaggccaggtaggtaaacctggaatcggatcgggtaatgtgtctgccgatggtaccgggcttgtagctggtaaaaagtatttgtttgtcccggaatcggacggaagtacatctggtgcgtttgtcgagtatgtcgcccctgaagcatatgatgataccccacttagaaaggaaatagccgataatctggctgcagccaagacttacaccaatgaacagatagctggtatcgttcaatttgatataaaagcggtcccggaactgccggataccggagtaaaaggaacgatctatttagttcctaaaaccggatcgggaaatgatgtccataatgagtatatctgggatgaaacttcaagtaaatttgaattgataggttctacttctgtcgatttatcagattactatactaagaatgaagccaacgaacgttatgttttgaaggaagcagggaaacgtttaatgacgaatgcggaaggagcaaagctggaaggtatagaatccggtgcaaataagtttgtcctgccaacaggggagggatataactttattccggcaggtggggcagtgggacaggttttaacaaacactgctccaggtgtagctgaatggggaaactcaaatagtgaatatatcgaaataggtgatgttactcaaataaatagagtacgaaccactagtgaattggattggggttcatttataaacggtaacacaatagaggatatggaaagggcatatcaagaaaatatacctatatattctatgacagagactaattatcattcaggcaaaataggttattcacgatgtacttccattatgaaaagggttgatggaactgtagttcattacttgttatcttttatcatatccgaaagtgttgcaaattctgacaatatatatcattatttattggatttgagaggtgtagcaggtgaaggttggcaggatgctactgtaagggcagcatgtacatacgctaagacggtcattacttctggtgagaatataccttttactggtggttatgtggtgtttgatatgagtattagcaaaaatttgctaattgttccagcaggattttatccacttcataactcggttactactttgctaattagaaacacaagtagttcaaccactaaaataacttttaccatcaagttaaatgccaatgctggttcagaaggttcaaaactgcttattgtatcagaattgccagaactggcaggtaaagaagcgtgcgaacttagcatattatgggcggactggaaatatactgttcgtgcgtctgaaccttttatttataatgaatacgtagaataatgaacagaagaagatcaatgctatttgcttctggaatgatagaggtcacccagatggttgtaatcaaatcatcggagatttatacaattcctgttgacactgttaaacttgaagtgtttatagtgggtgctggtggtggaggtggtctgcctgcagcatccacatcttatggttcctatacagctggatatgctggggaaggtggtgcagttgtatatcaggaaaacatgccattcattaaaggagaagaaataaatgttgtgatcggacaaggtgggagtgctgcaacaacagccaataatgcgggaaacaaaggaggtgatacatcttttggaactctcattgcattgggtggtaatggtggaactgccggaacaaattcatcgccatcaatcgggagtgatggaacagcttgtccatttggagatatagaatcggaagctattacgtcttctgatttatttggagcaaatggtggagatggaagtactaccactacggctaatgtaggagggaatactggcgcaggaaaaggggctaatcgttctacagctgctgctaatgctgctttttacggtgctggtggtggaggtggcactatttatagaacttttagtaatacgataagaaatccaggattaggatatcagggtattgttatattgaaagttacccgtatgataaaagaaagtgaaataccccttgttgaaaaatttgagataatcactgatatatctcggacctcttggactgtgcctgacaatacaaaaaaaatagacatctttatagtaggtggcggaggtggtggtgacggttcaaactctgtaaacactaatggagactgggtcagtggtggcggaggtggagaagtattatatgtagaagatatttctttcacaaaaaatcaaatatttgaattatcagttggggattggactgctttatcgtatggtggtgaaaaaggaaacccaacaacatttggagaatatactgtagcaggaggagaagcgggaaaagaaagcaatggtggatatccttataccaaagatggtacactttgtccttttggagacttatctcatatagacccggaattgactgcaacaacaaaatatgcggcaaccggtggttatgtaagatattctaatggtgaattgcagggatattcaggtaataaaaccggcggaggtggtggcagtattaagggcaatgccggaaatggtacattctatggatccggtggcggtggcatgggagtttctagcggccagttttctcgtcccggaagagggtgtcagggtataataataatccgatattatgtaaaatcctttgaataaagtctaattataggatctaattagtaggagtatcaaatataaaaaattagaggtatggcggataataaagaacaagtaatattagaagtagttattaaaaatgatgcagcatcgaaacggctcaaggagaataagcaggatattgcggaacttcgggaagaacaagccctgttgaataaaacgacactggaaggaaaggaagcctataaacagtatgaagatgaaataaagaatctgaggaaacataatgtactgttaaatcaagagatcaggaacaataataaatcaatagaggaccaggaaggcagtttgcaatctatgcgcgctgaactttcccggctgaataaggtatatgtgaatctaagccaaatcgaaagagaatcagcgaaaggacgtgatttgcagaagaaaattaaaactctcaatgatgaaattaaaacaacggaacaaggtttaggtgactttcgtcgttctgttggtggatatgaggaagcgattaaaacggccgctgatgaaaccggcctgttttcaaaagtgaatagttctctgaaaagtgtaattaccccttttcagcccctatacaaaaaggtacggcaagaggtcggtttacttactaccgattataaattgaactctgctgctacaactcaaatgtctggagcccaaaaagcggctgccatatcttcaaatctactttctacggggctgaaaattttgaagattgcccttatcagtaccggaatcggtgcgatcgttgtcgcgctgggttctcttgtcgcttatttgacaaaaacacagaagggaactgagttactgagtaatgtcatggccggattgggagcagctattaatgttataattgatcgggttgccaaatttggaggtgcattggttaaagtattctctggtgacttaaaaggggcagctcaagatatgaaagcgacctttgccgggattggtgatgaattacagcgtgaaataaaactagcttatgagttgaacgatatcagtcagcagttggaaaagcaggaagtaatgttgaatatgcagcgtgcagctgggcggaaagagattgaacggctaaaaatgatttccgatgatacaacaaaatcgaccaaagaacgtattgcagcagcaaaacaggctagtgaaatagaacaagccgatatgaagcaacagatcgaactcggggaaaagaagttggctaatttgttaggtcagaaagaagtcactcaggaagttcgggatatgttagaagctgtttctagtgggtctatgaaagccgatgatgctatatctaaacttggtctttccgagagtacaatatctgatttgagagagttttcagatttgtttcaaaatgtagtagacaaacaacgtgatagttatacgaaacagattgaacttcagaataagacaaattccataacaaaagagagttcaaaaaaggccctggagataaaaaagcaacagcaggctaaagaattagagttgagccgtcaggctgaagatgcagctttatctttagttaaagaagggatagaaaaacagagacaaacggtaaatgttcagtatgatcgacagatcgaagatttgaaacgcaagctcagtactgaaaagaatttaactgatgcagcaaagaaagcgttgaatgattctataattctggctgaagagaagcgtgacgcagatttgaagaaattatctgatgattctatccaggttcagataaaaaaagaaactaaacgtattcagttacaacttgctgcggttaaagcaggaacagaacaggaacataatctccgtctttctctgattgagcagaaccgacaggctgagcttgctgctaatttgttgctggctgaagagcttcggcaatcggaagccaatataaatgccgcatataacaaacaggttgcagatgaaaataaagcttttcggaaagagcaatttgacaaacaaatagatatgcttaaactagaatgggagaaccggctgctacaggttcgtgagggttctttggaagagcataacataaagattcaacaagcacagtcagaatatgatgctttagtgaatatggatgctcaggcaaaggcgactatgtttaaaactgaagaggattacgtgaacgctgtattaagattacgtgctaagattgcggaaagcacaaaacagatgaatgaagacttggagaaagatgctagagataaacgggcagccatcgcttctattgttggatcattagggagcgtattgggtagtatagcggatgacaatatcgcattactagcgctaactaaaactttagctattgcagaagtaatgctaaatcaaggtgttgcgctttcaagagcagcttccagtactaaaggcattactacatgggattatcttgcatctttagcgactgtgatagctgctgttaccgctcagtttgcttcaatcaagagttctgtaaacaaagtggagacaaatgttaaggcaccaagtttggagacatcaaaatatgcagatggtggcgatattgttggtccatcccatgcaaatggaggtgttaagattgaggcagaggggggtgaagctataattaacaagcgatctatgtctaatcccttactgcgttctatcgctagcgcggtaaatgtagctggtggcggtgttcctttctccaatgcaataaaagcgatatctttttcagaacgttctcaaattcaacaaggagtagcgataggaaatcttgatttaagtgaagattgtataaacaacatagctaaagctgtcgcttcgatgccggcacccgttgttagtgttgttgagtttacagaggtacaagatagagtgaaaatgatccaaaataattctactatatgaaagttcatgaaatattagcctttaataaggagttattagaaaaactctattctgctggtttgaatacatctgattttttacatgtcgatctttataatgagtatgcccggctaaaaagggatggattgaaaaaggcttatattgtttctttcctttccgatcagtataatatgagtgaacgaaaagtgtatcaagttatttctaagatggaacgctcagtttaatctctgtattatttatttcataggctgtatcgttttatcggtatggccttttttattactgcaaaatatgtgcagtgctttttcattttattttctcttataatatacaatatgatataaatttgcacaaaaagatattttaaatatggcggtattaaagattcacagcgatatagtagatgaagagacaaggcaaatgaacttgttttggatcggagtggacggaacttcctttgattccgtcgatgctttcattgaaagtattccggaagacgataacaatatagagttacgattgaattgtcgtggtggtaattgtatggaggggtggaccatttatgataagttacgttcaacgggtaaagaaataactgccattattgaaggtaaatgtgcatctatggcttctgtccttttgttggccgctcctaaagaacgacgttacgcctatcagaatgctacactattgatacataatccttatatcccaccttacactttggcagatgcttatgatgcagaagatttgcgacgtatggcggaggacttagaggccgaaacgacaaagatcgtgaatctatacgttgatcgtaccggctccgaggaagatgtactgcgtgcccttatggcggaggataaatttgttgatatggataaagcaaaggaattaggctttatatccgaggtgaagcctcctatatccgcaaaggaaaagcaaccaaagaaatggaatcactcaaaaacaaataatatgaatcaagaaaaaaaagtaacagtagcacaggcttttcaaatgctaggagtagcattaggagtcgttaaagctccgattgtcagtcttgatctgtcaacggcagacggaagtactttaacagtagaacgtgaagacggggaaccacaggtcggtgatacagcatccccggacggagaacatcttatgccggatggaagtacaatcgtcgtagaaggtggagtaataacagaaatccgcgatccggaagaggaaaataataatgacgaattggatgctgccaatgcgcgaatagcggaattggaagctgaactaacgtctttgcgtgctcaggctaaaagccaggacgaacttgtaattttgaataaggtcaaaactatgggaggtttggaaggcttgaagaaaattgcaagtagctatgttcctgatgcgcgaggtttccatggcaatcaaggtggacagggcggaaacagtgatccggtttctctgattgataaaaaactggccgaaaaacgtgatgcccgtaaaaagaagtttaacagataaaaaatgtttgtatgcctaagttagattttacaaaattaaccccgacaaatcatgcaattgagagtttgcgtgatttgttaaacatgactgtgtttcaggatgaaaacttggagcagtttattacgtcaatgggtaaaatagtccacggtaaacgccttggcttcattggagaaatggaagatgtcggtaatgagggggccggttgtaatccaacctacaaatcagtaggtattccggctgctgaaaagcagtgggaactaggggactgggaaatacctttgaatctttgctatgaagatttggaaggaacgatcgctgattactgtttgaaaactggtactgaaattggtgatcttacatctacggaatacatggattacattgtgttacccaaattggaagaagccatgcggaaaatgatgtggcgtattgcctggtatggtgataaagacgcgaaaaataacgctgatggaggtgtgttgacatctggtgtcgattcaactttgtttacgatggccgacggtttttggaagcgtatttttgctattgctgccggtaactctaatcaatatacagaaatctcagcgaatgacacagcatcttataccgctcagaatagtggattatatacgaaaggggttgctacttccttgtttgaaaaaatcaggagagatgcggacggacgtattgaagctatgaacggagccgcaattttctgtacaagatctctatctgatgctttatcatgggatgcaaagcaatcttataacacaattatgccatggcaagtattgtttgatggtttgaagatatcagagtgggatggtgtgaaaatttattctatttcgttatttgataggtttacaagtaagtatcaagataacggaacaaagttgaatttaccgcatcgtgctgtatatacttcacccagtcagttgctcatgggctatccgggtagttctgctatttcagaacttgatgtgtggttcgaacgtaaagaacgtatgaactatatctattcaacgggtaagatcggtactcttatcaaagaggacgaactgattcatgctgcttattaataatccggggtatggtattctgtaccccatcaaatactcatagatatggcagattgcgaaagtttaattaaaaaagatattgatatcaactgtgatactccggttactcgtggtttggaagctaatgcagtaatcattaatcgttcggatattgattttgcaaaaagcgtgtttgctacaggaaaaagcaatgttcttgaggctcttgttttgaagacaggaaagaaaggatataaatgtttcgtaccgggtaaaacaccctttaccgggactaaaacaagtctgaatgttggaacctatgtaaatacattcaataatgagtttgcaattgtgatccttgacaacggaccggagactagcgaaagcattattgatggtttggcaaatgggacgtttgtagtcgtttatgaaaataaacataaaggtacaacgaaagatgctgcattccaggtttccggtttttatcagggtatgactgcaacgacattggagaatgacaaatacagtgaggaaactgaaggaggttggaaagctgtgttgacagaagaacgggccccgaaatcaggtttattcctgcataaaactgattatgaaacgacgaaggctttgtttgatagtttaatagcagcagcttaatactgtataggaatgagagtggatgaactattgacaaatgaagtgatcgagcgttttcgtcttcggaaagaaacaccgcaagaacgggatacgctcgtttctttggcttctaaagctctatgtcgcaaaatatcctacacttgtaggaactgttattttgatgcgttgatggaactcgtcaacctttataaaactaatcgaatattatttgaggaacgtatgaaagaaaaaagatatcagattgcccgaggtatgtgtatgcctcttggctttggttccagtcgtatgatcgtgtaccagaattgtacggatgagttagcgatcgaatttttgtctttggatgaaaaaaacagtaagtattttgaacgtctgcctgatggatggaaggatgatgttgcagaatatttggataagttgtcagggaaagaacatattcctgttgaattaactcctgccgaattggatgctatcgccgatatgaaaagaatgcttattgaaggtatgacaaaaagagctgtaaaggagcattttgtgacctttgataaggttggtgatgtaaaggttacgaaaaagtatattgattctttactgaaagaggcatctgaacaattgaaggcagaaagtgagaagaaaacagatgatccgggtaaagatggtgcattggagaacggagaaaatccggatcagacggaagtggattaattgatacaatagacttgtgaaatatgacaattgatgaagtaaaaataccgaaaatacgtattcctgtagcagatgtaaccaacctggatatacaaagttatggaaaggggaataactatcctcagatgatattgcagttgttgggtgcttccagtaatgcgaaaagttgtgttggtcggtatgcaaaatttattagaggtgcaggtttcaaagattccttattttacaagtctattgtcaatatgaaaggccagacatgtgatactttgttaagactctgttctgatgatttggcaaaatttggtggatttgctttgcacataaattacaatcttctatgtgagattaccagcgttgagcatattccttttgaagactgccgtctgggtattgatgatgataccggatatatagcccaaattggcatacacccagattggacctgtttgaagggaaagaaaaagatcaagaaacccagtaaaagtactattgcctatacagatgtgtttaatcctaatcccgacgttgtactatctcagattgtggcagcaggaggtattgaagcctataaaggtcagacgttatatgtgtcaaaagatgggttcatggtctatccatctaccatttacgacagtgccattactgatataagcaccgatgaaggtttggcaaatgttcgttatcgtaatgtccggagtaattttttgccgatgggtatgttcgtttatcccaaaggacagaaagtcatggtagaagataaagatggaaattgggttgaagggacagaatatcagaatggttttgatgcagcgaaatttaaagattttcaaggtgattccgaagcatgtaaaattttaggtgtagggcgtgaagatggagacgatgttcctcaatttgtcgagttcccaaccaagaacttcgataaagactttactgtaacaaaggatgctgtagcggaggaaatacatgcagcgttcaatcaggaggtattttaccgtattcgttccggtgcactggggttttcaaacgacattattaatgatgcctttaacttttataatgctatgacgatcgacgaacgtgtcctgatggaacaaagtttccgatctgtgttctcacattttacatatccggttaatcaaacaaacgactattcattaattcctttaagttatgaagtccaatctgtttaataagcaattaacggacgtagatagtgtaaaaactaccattcgccccatgtcgacgcatgttgatgttgaaaaaatacttgtgtacattgatgaatcccagcagcaggatatcaagaatgctttaggtgataaccttttcattgatttactccggtatgtcaaccgtgaggaaggctcgccggtcaatgatgcctatgagaatttgctttatggcggtatctataaaaatggaaatgatgagtttattttctcagggcttgaaaaagcgctaaaatatttcgtttacgctcgtttggtgaaacatggagacaggaacctgtcacgggtgggattgatgcagaatcaggttgaatatagctcacatgcggagttaaaagaaaagcaggaagagtataaggatgctttttctgttgctgaggaactgatgaatgattgtctccggtatatcaagcataattcagataagttccctaaatggagaaaaggaagcattactccggttcgtggtcctgtaatttctaaaataggggactgatggagaactatacagataaattcctttttggactgatcgagtttttcagttgggcgaaatggcttttcttcctggctttagtgctgacactgggtgatctgaagttcggtattgaagcatctcgatacaggaaagacccgatcaaacgatcgcgagctgtccggcgtacaatggataagattacaagttatatcatttgggttgtaatggcttattcgttcggccaggcttttgggcaaccatttgggatcgacttgctaccgcttataattctactcgttatatacggtgttgagttagaaagtatatatgtcaactactttgctgcacgtggaaagcatgtaaaagtgaagttcttgaatttctttggaaagaaaacagatataatagaaatagaaggtgataaaaatgagacagataaataaaatcataatgcattgtactgcatcgcgtgaagggcagtctcttaccgttgctgatattgataagatgcatcgggcacgcggatggaacggtatcggctatcattacgtagtttatgctgatggatcagttcataaagggcgaccagtagaaaaagccggggcgcacatttctgggcacaatgcggacagtataggcatttgttatgtcggtgggctagatggttccggaaatcccaaagatacccgtaccgaagcgcaaaaggctgccatctgtgaattggtgaatgagttgtgtcggaaatatccggctgttgtagaagtaaaaggtcatcgagattattcgcctgatctaaatggtaatggtgtgattgaaccttttgaatggttaaaggcttgtccctgctttgacgtacagagtgaatttacatcgttccttcccaacgtaaatgtaaaaccatgaaaggcattgtattactctggtgtatgtttctcttttttggatgcggaacaaaaaagcaaagctacagatcggaaacggttagtacagctgtcagcagtcaaaaggatagtacacatgtcacggaatctgttcagcggacaattacggagttactggagtataaaggaaccggtatcataactataacagagttatccaagccggacagtatcggcaatcaatatattgtaaagactacccagatggatatccattccgaacaaaaacgatcggtgacaacagaagagaattgtgataggcaggaaacagatacatctgtcaaagtgaaggatgaaggtataaaagatgtcgttacagatgatgtgctgattgatcgggaggctgttttacctaattgggtatttgggctgattgttattctgtttggttgtttgggtttatggatagtcaggaatattaaatagaactttttctcatagtaatagtttagttagtaatgtaggccgctttgcctgagataggtagagcggttttgattttttgtgatgaaattcttatttaaaaattatattactattatatttgcaaaaaaaagaattactatgacgcggaatgtgatttcaacagcttttgttggtgtttttaagaatttgcacaataatattcctgttttggataataagttttgtaaggatctttttggtaatccttacgatacaaattgtggtataggacctgagggcttttttattggaatgaataaacctgttccaagggttgtgatctctcctcaaaaaatagtatttgttatgtctaaattagatgacgtttttaatacagtagaaaaagttcaagaggaaataatgagagttactgataattcttttgattttgcattgtcttcgtatgggttaaattatgaatatgagtttttagaactagaaaaaccagccccaatttggttaggttgtaaatttgctagttcgataaataatgttgcagaatcggataatttggtatcgtgtacaggtattggtctacagtttgtattagatgaaagtaatgccattgctgtagatattcaaccaagaaatggggtcattgatggattgtttatgtctgttaatcatcatcatgatgtaaaaatggaatctttaccttcgaaacaaattttggaacaggcatttgatgaatctcaaaaaatggtggaaaataaggttgtaaatacaatattgaactaagtgctatgaatttaaaagtgtcaacaaataatcaatcggaagctttttccatgcaaaaaataacttcacagagtgcatctgtggtagtttttgcagcgttattatcttcttctcagttgaatgttaatcaattgtatgaaagacaaagccccaacatgttttatccttcatatcaaacgggaaatcatataagtaatatttctaatttaaaaaatgggaatactataatttctaaaagagattttagagagcgatattcaaaaatttcaaagtcaaagtggtttgttcaagcttatgaagggcagagtctgggcgatgttataaaagttgaagaatagtatgtcttggttgaaaaatccagaaaaagagattactcaaggttctatcattgatggaatagaatgggggatgggggatgatccattaagtattgttctttctaatccttgtgatttagaacatgggaaagccagttttttaatagttgcagcattattgcctgctaatgaaacaatatctatgtctaaagaatttttgagtagaattaatgatgtggaaagttttgagttacctagaaaaagatggacttcattgtctaattatttgttggatattattcataataaggtaataattcgttatttttttattgatccttctgatgtaatagactctccatctttgctggttgattttcaattagttagatctgtcccgatatctagaaagaaagacttaaaatatatagcacaattaccagatccttttaaagagcaaatgattatgcattttgcggcatatacttcaagaattgcagttaatagggttgataattttagagagtctcagttgatattggaattagctaaaccgtataaatcatcggtatagttgaaaagtttcaaaatttttacgggctggatgttttttctaaactcaaatacgcttttgattacacaattgtatttagtctggcgggtccggtagttaatttctatcgggctttctttattctcctttaaaaaaggaattgtctgctatccgtctggcattttcttcaatggacacttttaagtatttgattgtagtctcaattttagaatgtcctaataaatcctttataacaaagatgtctgctccggaaaagtataagttagtagcaaatgatctacgtgccgtatgtgtagatatacattcgttcttattatatgtatatgtattgataactccaccttcagttttagaaattttcacttcatctgttataccggcaattaagccaagttctttaatatggtcgttcaatctttgatctgacatcttaatactcatgatatttgttttattcaatagggtccggaagtttttatgtattggtatagaaacaattttatttgttttttgggtgcgtattttaatgagttctttatctatgttgaagtcttcaatgcgtgaatagtctgatatccggagaccggtatagcaaccaactagaaatataaggcgggcattgttcaacgcttttacttttcgggtgataccggatggtcgaacatttttaaagaaagtttgaaccgtctcggctgtaatatttagatcaaaaatcttttggacctctttcttcgtaaggtatatcgaatcagtttcctccttttcttttttgaaccttttatctatataagctgtgttgttatgtagttctccggcagattcattcatgaatttggttatcatcttgaacagtcctcctatatagtttttggaataatggcgttgttggtcttttatggtatatgtctttgtgagcatatgtgtacggaacccattatagaagtccatgtttatgttagagaaacgaagtttgtaacctgtttcttgttcgtatgcgacaagatgattgagtaaattttgatagttcctatatgtaccagtcgttttatcgcatgtctggatatagttcgatatataattagttaaaagagagtcatcttttactacacctccggctccctcatttatttgtgcaattttgctatcaacggcctttttgaatgattgctgggttggagtaatcagttccttgtcaaattcgataaatactgaatctatgatattgatatatttttttatctgttcgttttttagaaagccatcaggatactttttgccttcgcgacaccagcgttggctatcgatccagtgttcggtccgaatagatatacctggagtgtaacgatatctttctccattttttctaatgataaactgtatagatgttgtttctttacttttgtcaacaaggaacggatttatcttatttgccatttggaacgaattttggaacgatttgtgtaaatgttgtgaatgcgaatatagtcaaaaaatagtaatgcctgaaaaaagtgataatgcatgtgtttaatttaatgataaacaaatgctttaatccctcccgggtcacggttgcaatcataaaggcgacaccctgtaaaggatgtcgcctttatgtttccgtacttatccttagcctatcaacatttgatggataatgaacctattttgttactgatatcgcgtaacgcaaagtttagtatgtcaatttcttccgggctaagtgaatacacttgtcctctaatagaattaccattaatgcgctgatatagccaagcacggcttttaccaaaatattttttggcaatgtaagagagggaaacaacttcggaaatgtcttttagctgttcttttatcgtgagcgctttgccaatgtcagctatttccgacttgatatcggcaagttcttctatcagatgtttgcggatggcctctttatcttccggtgaagtgtagtgggctttcatttcatccatgaataaatctaactcctttccggtaaggctatccatttttttcaagtcttcttttaaagttctcatattacataggtttaaatcccctccggggaagggaagtattactttttcttttttaattcttcaattcgattttttaattttgaaatctcatctagcattttgtcagtttcgatttcatctgtatgaggatcgatttcaagtacagtgacttttcgtttccaggaatatatacgggcttcaacttgagcaatcttaaattccagtttttgaatatcatccatcttagtttggttaacattaatactcgtgttatctgataatgcaaatatacataatcatttggttatgtgcaagggttaatccaaataattaaacagatatattactttatcaaaagtttccaattgatgattcagtatgtccggattatcttgatacattttgatactcttaatcaataacggtgttagtttaattccttcgacagtcgtaatagagctcctttctttttaattgtagtaacgagtatcctacttcggagatttgatacggttaatgaatttgatttcatacgataatgtaaaacaaaggcatctttgaattaggagccaatagctttgtagttagaaagctattaggttacaaggtgtggaagcaatgaacatttctttacttcttttgttttatatatagttattaatcttatgtaaaaactagataatatgttggcgatatacagatttttattcccgtctaaaccgaatggaacagctatttcactgttgttattggcgttacgtattcttttcgggggattgttgttaactcatggtatccagaagtggactaatttttcggaaatgtcagccgtattccctgatccgctgggagttggtagtcaggtttcactcggacttgctatatttggggaactggcttgttcgataggttttatcttcggtgccttatatcggttggctatgataccgatgatctttaccatgtgtatggcatttttcgttattcacggaaatgatgcttttgcggtaaaagaacttgcctttatttatttggtcgtatttatactaatgtatataaccgggccgggtaagttctcaatagacaggtttatctctgtgccgttgtcgaaaaagaaaagatgattatgaagtaatataataaaaaaagtccgttaatcattcgactaacggacttttcttttagtgggcgttgacggattcgaaccgccgaccctctgcttgtaaggcagatgctctgaaccagctgagctaaacgccctttcattacttcagtaagttttgtacgccttatctctctaaagcgctgcaaagatacggctttttttattacctccaaatctttcggcaaaaaaatagaaaaaaagttcattactgccctttagtctgaagaaatatagtaactttgcattctatattattaatgtacatgaagtaatcgatatcgttggcatatcgcccgaacactcagggttataggtgtataaactaaatgaatatgatattttcgacactaactgccatatctcccgttgatgggcgatatagaaataaagccgaaaacctggcggcttacttctcagagtatgcacttatcaagtatagagtgcaggtagagatagagtattttattactcttgctgagttccttccacagttgaatagccttgctacagtggaaaacaaggaagcattgcgtaaaatttaccaggaattttctgtagaagatgcaacacgtatcaaggagatcgagagtgtaaccaaccatgacgtaaaagctgtagaatattttatcaaagaaaaattcgacctgctgggtttacaggattataaagaattcatccatttcggattgacgtcacaggatattaataatacctctgtgcctttgtctatcaaagatgcgttgaatgaagtttattatccgggtatacaggaagtgatagacatattgaagaagtatgccgaagattggagtaacgtttctatgctggccaagacacacggacaaccggcttctcctactcgtttgggaaaagagattatggtgtttgtttatcgtctggaacagcaggtgactttgttgaaatctattcctgtatctgctaagttcggcggtgcaaccggaaactttaatgcacaccatgtggcgtatccgtcgtacgactggagagctttcggtaataattttgtgaatgaagtgctgggactgagccgtgaggaatggactacacagatttcgaactatgataatctggcagctattttcgacggtctgaagcgtgtgaacacgatactgatcgacctgaaccgcgacttctggcagtatatctctatggagtatttcaaacagaagatcaaggccggagaagtcggttcgtctgcaatgcctcataaggtgaaccccattgattttgaaaatgcggaaggtaacctggggatggcaaatgcaatactggaacacttagctactaaattgcctatttctcgtttgcagcgggatttaacagactctaccgtattgcgtaacgtcggtgtacctttggctcatatcgagatcgcattcaaaagcttaacaaaagggctgggtaaactgttattaaatgagagcgccttgtatcgggatttagatcattgctgggcggtagttgcggaaggtatccagacgatattacgtcgcgaaggatatccgaaaccttacgaagccttgaaagccttaacccgtacaaatgaagggatcactgaaaaatcaatcagtgactttattgaaacgctgcaggttagtgatgcagtaaaagctgaattaaaggcgattacgccgcataattatacaggtatttagtgtgagaatcaacgtagccgtgaggttaccaattaattaattattattaatttacaacaatgagcacagaagaaagagaagaatctcaaccgcgtcctagaaaggtgataccaagtatcagacgggaaaacacagatcaggaaggtgaaagaaaaccttacaatcaaggttacagcagacctgagggaaacaactatgaacggagaccatataaccgccctagccgggatgaccgcggtggttataattcttatggtgataaccgctcatcttacggagatcgcccgagccgtccccgtacgtatgacaatcgcgaaggtggtggttataacagcagaccttcttacaacaaccgtgacaataatcgcggtggttacagcaataaccgtgaaggaggttataactcaaatcgtgaaggtggttatagttctaaccgtgaaggcggatacaaccgtccttcttatggcaacaatcgcccctcttacggtaacaatgatcgttcttatggaaacaacgatcgctcgtatggtggtggtttcaaccgtccttctcgtcctagctatgacgaaagaccaggcagagcctattccgcttctccggaaggagatgcaaccggcgacggaatgaagaaaagaagacccagagtaggtgatactcgtgtcaattcttatgactcgcgtgataatcgcggtggtggcagaccttcattcggtaacaataatcgcggtggaggatatggaaataatggcggtggatatggaaacagacgtccgcagcaacgccgtacaaacgattacaacccgaatgccaagtacaacttccagaaacaattgaagtataaagaagtattggctgaccctaacgaaccgatccgtctgaacaaattcttgtcgaatgcaggcgtttgttcacgtcgtgaagctgacgaatttattacagcaggtgctgtgaaagtaaatgatgtagtggtaactgaactgggtactaaaattacccgtcaggataaggttgaattcaacgataaaccggtgcagatcgaaagcaaggtatatatcgtactgaacaaaccgaaaaactgtgtaactacatccgacgatcctcaggaacgtcttaccgttatggatctggtgaagaatgcttgccaggaacgtatctatccggtaggtcgtcttgaccgtaacacaaccggtgtattgcttcttactaatgatggcgacttggcttcaaagctgactcacccgtcattcaagaaaaagaagatctatcacgtttggttggataagaacgtttctatcgaagacatggaaaagattgctaacggattggagctggaagacggcgaaatccatgcagatgcaatcagctatgccagcgaagacgacaagagccaggtgggtatcgaaatccactcgggacgtaaccgtatcgtacgccgtatcttcgaatcattgggataccatgtaacgaagttggatcgtgtatactttgccggattgaccaaaaagatgctcggacgtggaaaatggcgttacctgaacgaacgtgaggtgaacgcactccgaatgggcgcttttgaataatagtaagattagccggtagtcaataccggctatcttgttttgattatctaagaataaacatataaacatggaaacaattactagaacaaaaattgtagatgtactgaaaagtgaagcttatggtacagccgttaacgtgaaaggatgggtgcgtacccgtcgtggtagtaaacaggttagctttattgcgctgaatgacggttctacaataaataatgttcagatcgttgtggatgtggaaaaactgggtgaagaatatctgaaacccattactaccggtgcttgtatcagtgtgaacggtgaactggtaaaatctcagggacagggacagagtgtagagatccaggctactgaaattcagatttacggtacggccgatcctgctatttatccgttgcagaagaaaggacactcgttggagttcctgcgtgagatagctcatttacgtccacgtaccaatacgtttggtgcagtgttccgtatccgtcataacatggcgatcgctatccacaagttctttcatgaaagaggtttcttttatttccatactccgatcattactgcttcagactgtgaaggtgccggacagatgttccaggtgactacaatgaatctgtatgacttgaagaaggatgaaaatggttctatcatttatgatgacgatttcttcggcaaacaggctagtctgacagtgtcaggacagttggaaggtgaattggctgccatgtctttaggttctatctatacgttcggaccgacattccgtgcagagaactccaatactccacgccacctggccgagttctggatgatcgaaccggaagttgccttcaacgagatcgaagagaatatgcagctggctgaagactttatcaaatattgtattcaatgggctttggataactgtatggatgatatccagttcctgaacaatatgtttgataaggaactgatagaacgtctgcaattcgtcctgaaacataactttgtccgtctgccttatacggaaggtgtcaagatcctggaagaagcagtggctaaagggcataagttcgaattcccgatctattggggggctgaccttgcttcagagcatgaacgttatttggtggaagagcactttaaatgtcctgttattctgactgactatccgaaagaaataaaatctttctatatgaagcagaatgaagatggaaagacggtacgtgccatggacgtattattcccgaagatcggagagattatcggtggttcacagcgtgaagaggattatgaaaaactggcaagacgtgcttcagaaatgggtgtacctgaaaaggatatctggtggtatatggatacccgtcgtttcggtacagcgcctcattccggctttggtctgggatttgaacgtctgttgttattcgttacgggtatgacgaatattcgcgacgtaattcctttcccgagaactccgaataatgcagagttttaataaaacatccctgctttaaggcagggagttttcaataataaaaaaggactttccgatatcggaaagtccttttttatttattattcgtcatccagatcaatcggtatttgtctcttgaatgcttctttgaaagagatcagcgattctgtacgggctaatcctaacggctgaagtttattgtggatgatattcagtaagtgctgattgttttttgcgtatattttgataaacaggtcatattgccccgtagtgtaatgacattccactacttccggaatcttctttaatgcctctgtaacggaagggaactgtcccggtgatttcaggaataaccccatataagcgcaagtctcatatccgacttttgtattatcgacgataaactcagatcctttgataacccccaggttggtaagtttctgaattctctggtgtatggctgctcctgatacattacattccctggctacttccagaaaaggcattcgggcattccctatgatcagttttaatattttttcatccaattcatcaagttgatggtgtgccataatttctgtatatttgtatttctgttattctgtgtgttacatttaaatacaaatatagtcaaactataatgattagatgctataattcgtccaattattttatttcgtaagttttcttttattaatcaatcaatattataagagtatgagtttaagtgcggtaatcgaatgcaggccggtaaaagatttttccgatcctttgttggataaagtagaaaagacatataacgattcctttccggaagccgaacgacgggtattttctctagtgaaagaactggtaaaagaagagccccgttttactgtatatacattgtttaggaacggagcttatgcgggttttattactgcctggcaatttgagtcttttgcttatgtggagcattttgccatcgatgagtcagcgcgtaacggtggaataggagcagaggctatgaggcagtttatggctttgtgtgacgttcctgtgatattggaggtggaaataccttctgaagagatgagtaaacgcagaatcggcttctatgaacgtttaggatatgctttggataatcatgtctattaccagcctccttatcgtcagggagaagagtttctggaaatgcgtttgatggcttatggtaatatagacctgcaacaatcttttgaagaggtaaaagattgtattcaccgttatgtatatggtgtcaaatagattcggtttttatcccaataaaaaaggcagaacttttagtcctgcctttttctttattctagaattaattaatccactttttgtcttgcagaataactaatcttcaatgcgtatgcttcacgaagcgcctgttttacgtctgtaataacacccatcttggtttctttatccgccttgatggatacagtcataaacggctggtcttcctctttcatacttgacttttcctgagcgatgtaatcttgaatctcatcaacgtctgcgatctgatcgttcaactgcagacgagtttcagaacccattttcgctctcagttcctgagtcggcttaccaacataaatgaatgttaccaatgatttcttttccaacttctgaagctctgtagcctgaggagcctggaataccacctttaaagtaacttcacgcatagaagtaaccatcatgatgaagaacaagaaagcaaataccaagtcaggtaatgatgaggtatttaattcgggcatttctcttccacccgctttactaaattttcccattactttttgtctccataatttttaggttctgcttcggaaatcttctgaggatagatcacctgtacagccttttgttgttcttcttccaaatctgcaaaagctttaccgaatttctttctggcaacatcgtctctcagttcgttataggctcttgccaattcgttctgaacgtcgatgtaggcctggtattccgtaccgcggtcattttgtaaagagataacgtgatttttcgttaccatcattttaccatagaacggtacatctacttctaccttttcgggtttatgctcatcgttataaggattttcaatgaattctttaaccttgtctttcaattgcttaatatcgatgaattgattatcacagagaatttggttgttactgttgatcagtaccaccagaatatttctctttttgatatccatttcttcatttttcttctgatctttgggtacaggaggcggtaaacgtcttgccaaacctttatctgtatccattgatgtagtaataaggaagaagataagcaacatgaaagcaatatcggctgaagaagtcgcattcattgcgggcacttttcttttttttcttcccatatcgcttgatttgttttatatcgtattcttattactattatctattaagcattctttttacagagccggcagcaacagcaacaatgattaaaatcatcaagatagctgaagaataaatccacatgtctgtaattttgagccaaagaggaatattgtattcctgtgaatctgcattcaaacctttcaaaggtgttgcatcgcctattgaataagtgattaacaacattgctgcgaagcaaatgataacgatgaatgatgctaatgctgatttcggactggttttcaataatgatgtaaattgccaaatagcgaatattactgtactaacaattgtcacgaagaacaatacacttgtccagttgagcaataagccagtatatataggctctttcatttcaacagaagggtctacaacgcctcctgcgtagaacatacccaatacgacaatactgataatagatgtgagcagtaatgtccagctggatatttttcttattttagtaactgccataattctgaattattttttgaatttaaggttgtatttgataaccatatcaagcaatgtgatagaagcatcttccatctggttcaggatagcttccagtttgctcaacaaatagttatagaatacctgaaggatcaaagcaacaacaagaccacctactgttgtgatcaaagccactttcataccaccagcaacaaccgtcgggctgatatcaccaacctgttcgattttatcgaacgccataaccatacctactacagtacccaagaatcctaatgacggagccatagcgataaacaatgtgatccaagacatgttcttttccaaaagaccaccctgtacaccaccgtaagatacgattgatttttcaacaacgtcgataccctgatcaattctcattaaaccttggtaagcaatagaagcgataggacctcttgtgtcgcgagcaatagcttttgcaccttctacatcacctttatcaagtgcatcttcgataccttttaataatttgctggcattagtttcagctaagttcagataaataattctttcaaggcagaatgccaaaccgaaaatcaaagcgatagcaaccaaactcatgaagtctgcaccaccctcgatgaacttaacttttaaagcctggtacataccaccttcaacaacttgttcagctccggctgcagcgtcctgcgcgaatgctacggtagagattccaagggcacataaacccatgaatgtttttgcaaaatactttttcattgtgtgtttaatttttaagattaataattctcttatttgtttttatttttgttgttaataatatcctcatggtatctaagcggagagagcgggattcgaacccgcgatacactttaggcgtatacacgctttccaggcgtgcctcttcaaccactcgagcatctctccaattttcagccttcgtctcctctaaaacgagcgcaaaatacgaaaaaaatcgcatatgcaaacgtttcagtgcacaaatctaaagtttttgcttgacatatacacaatatctggcggaataaatttggtcttccagctgaaaaagtcaaactacgcatgtttattagtaattttaaataaatccagtgcgttttttcttgttatttctaccgtttcacccagtgtaagaccatatgtgtccgctaccttttctgccgttttccatatatatacgggctcatttcgtttcccccgatatgggacaggagccaggtatggagcgtcagtttcgagtactatgttgttaatgtcggtagataaaattgtctccgacagttttgaatttttaaaagtaattaccccgttaatacccaatttgaattttttcaatttcttaatttcttccagttcagtctttgtacctgtaaaactatggaaaactccctttagtttttcggctccgactttatggatactctcaagaacttccgggtaagcctctcttgtatggatcgcaaccgggagatcgagatcgatgctccattttagttgttcttcgaatactattatctgttctttcaggtatgtcttatcccagtataagtctattccgatctctccaataccacaataaggccgtttgtagagataggattccgttttttttagcgtgtcaatatagtgttcgtccacacttgtcgggtgtaatcccatcatcggataggcaaaatcgggaaaacggtcgcataggtcatgcatccgttctatcgttgtgagatcgacattcgggagaagcaatgtgtcgatacccgatttcagggcggcatcaaccagtgcatcttgttccgggtcgaattcttccaggtacagatggttatgcgtatctattaaattcatgtgattaagactggcgatacattaaatggttacttacttcttttaatatagtcagtttttcctgcgatacatttaatgcggagagatgttccattgctttgtcgtaatatccctgcattttagccgttgtgatatcttttagatttaatgtattatatatggcagtgattgctttgattttctcagcggggatgaaagactctttacctatccagtcttttaggatttgcttttgttccatgctggcgagttcaaaagcatgtatcaacaggaatgttttcttgttgcagataatgtctccaccgatattttttccgaatgtcgctgtatctccatatacatccagcagatcgtcttgcaattggaatgcgagtccgatgtttattccgaactcataaagattcgtggcatcttctttggatgcacctcccatgatagcacctgtttttaagctacaggcaagcagaactgcggtttttaaccggatcatttctatatattccgcttctgtaacatccgtccgtgattcaaactccatatcatattgctggccgccgcatatctcgagtgcggtggtagtgaacaggtcgaacacttctttcagatgttccggttccgtttttccgatcagttgataagcggcgattaacattgcatctccggaaaggattgccgtgttgtcattccataccttatgaactgtcggtttgtttcttcttttgtcagccttatccatcaggtcgtcatgcaatagggtaaagttatggaaaacttctattcccaatgccgggttgatcacgttgtctacattttcacggtataaattacaggccattaatgccaatgccggacggatcctttttcctcccaatgacagtatgtattcgatcgggtcgtataaacttttagggggatattcgaaactgagttgagatatttcgttttctattttttgcaggatctcgttgaaagataacatatcgatattgaattatagataagacaaaataaaaaaaggctgcaagtttacagcagcctttttaatatgtttagaaattattattgtaatctgaaagttacaggtactgtatattttacacgtacaggtttacctctctgcttaccaggagaccatttgggcatgctattgatcacacgcaaggcttctttatccagagatgggtctacaccacggataacttctgcgtcaacaatagaaccgtcacggtttacaacgaacgaacaagttacacgaccttgaataccgttttcctgtgcaataaccggatacttgattgattttgcaaggtatttcagcaattcaccctgtccacccgggaattccggcattgtttctacgactgtgaagatctgttgagcggattcttcttcttcttctacaactgcaggtgccacataagcttcaacctgtgctgaagtctggtcatcttcagatgagataagatccacttgatccagttccacgtcgtcatccacaatgttcagttgttctactgcagcaggtgctggtggtggggggggtggaggaggcgtatcctccggtcttgtaatttcaatttcctcttcagcgatgatatcagcgacgccttctgtttggactacctgaatatcacgggttccccattcgaacccaacgaatagaacggctaagccaacaaccatacccatcaggataccgagtgttttgcccccttctaagtccgctttcggtgatttcttaatttccatactcttataatgtttaaatatgtgttttccagtacgcaaaaatacaaattattttatatatcaatagtaaactgggaaaaatacttttatattttcgtttttttttgaaccgaaagaaaaataacagtgtttatatacctttttcctgttttttccgtttctgtttatgaaatatgtaataaccgtatttatatctttgtacgcattttgttgaaaaatatgagaaatatattagctgtattgttcctttcgttctttgtgcaatctgtcgcggcccaaaccggagagcaggtgtttacttttttgaactacccttcatcgaccagggcgaatgctcttggaggtcataccgtgtccctgatagaaagggatccttcccttatttttcataacccggctttgctgggaggtgaaatggacggtatgataaacctgaactatatgaattatatagcagacgtaaatgttggaagcgccctgtttacaaaagcgttccgtgaacgtggagcctggggtgtcggagtcaattatttccataacgggaaattcatagggatggatgagcataatcagccgaccgctgattttacggcaaacgatattgctgtcaatggttttttctcgtatgatttatcggaacgttggcgcggaggtgtttccatgaagttcctctattccaattatgatatttatacatcgctaggacttgcggtggatgccgggttgagttattataattcggaaaaagagttctctttcggttttgtgttcaaaaatatcggtgcacagttgaaaccctacaatgatgatcgtcagaaaatgccttgggatattcagatgggtatttcaaaaaagatgaatcatgcccctttccgtctatccgttacagcgatgcatctgaatcgttggaaattcgactatctggatgatacggatcccgactataaaggtgataacttcgcccaggcattgtttaagcattttgtgttcggagtagattatatacccagtgagaatttctggattggtgtcggttttaatccgaagacaaagatggatatgaagctccaggggggaggaaatgggttatccggtttctcggccggtgccggcgtgaagatcaaaatgttcgacgtaggtgtttctttcgccaaatatcatccttcagccatgtcgatgatggtcagcgtttctactacactggccgattttaaaccttgaaaatataattaaagtaagaatgaaaaagatagtgatcgccatagatggtgtttcttcaacaggaaaaagtaccatggcaaaagatctcgccaaagagattggttatacgtatatagataccggagctatgtaccgggctgtaacattatattgtattcagcataatctgttcaagggagaccggatcgatgaggaaaagcttcaggcggcaatgaacgatatccatatatcccttcgtttcaatccggaaaccggacgaccagatacttacctgaacggtgttaaagttgaaaaggaaatacgcggaatggaagtggcaagttgggtaagtcctgtggccacgttgggatttgtccgtcgtgccttagtcgccatgcagcaggagatgggtaaagaaaaggggatcataatggacggaagagatatcggaactgttgtttttccggatgcagaactgaaaatatatgtaaccgccagtccggaggttcgtgcgcaacgtcgtctggatgaactgaaagccaaaggggaggctgcctcttatgaggaagttcttgaaaatgtgaaaacccgcgatcacatcgattcgacccgtaaggaaagtcccctgcgtaaagcagacgatgcgctagtattggataactcgcatatgaccattgctgaacaaaaagcatggctgcttgttcaatatgaaaaagctatctctaaataggtaacagttacaatgattgaagtagaaatagataaaggctccggcttctgttttggggtggtgacagctattgaaagtgcagaacgtgaacttaacaataccgatatattatattgtttaggggatatcgtgcacaatagcctggaggttgagcggttgcaggcacatggcttgcggacgatcgatcatagagagttctctactttgaaaggaaaaaaagtcttgcttcgtgctcatggagaacctccttcaacctatgagattgcccggaagaacgatattacaatcgtcgatgccacttgtccggtagttcttcaattacaacgtaaaatacataaatgttaccaggaaacccgtatcaacaatacgcaactggtcatatatggtaagaaagggcacgccgaagtgaacggtcttgtcggacagacggaaggaaccgctattgtcgtggaaaagatcgaagacctggatcgtctggattttaaccgggatatctgcctgttctctcaaacgaccaaatcgctggacggtttccgtaaagtcgtgaaagagatagaacaacgtagagctgaaaatgtccgctttgaatatcacgatacaatctgccgccaggtagccaatcgtcttcccaatatcaaagcttttgcatccagccatgactgggtctattttgtagccgggaagaaaagttcgaacggaaagatgttgctggaagaatgtcgtaaggcaaatcccaacacgatcttcatttcagaagtgaaggagattaccgaaccgcttccggccggagtacgccgggtaggcgtttgtggggccacatccactccgaaatggctgatggaagaggtggctgtccgtattcaggaactgaatgccgggcgttgatagaatgattaagatttcattaagtttcagagaaaatgaaagaatgttggcaaataattattatttttgccgcgaataatataaaataaagacgctatgtctactattaaatgtattggcattttaacgtccggaggtgatgctcccggaatgaacgctgccatccgtgcagtgacgcgttccgctatttataacgggattagggttaaaggtatttttcgaggctacagaggattgatcacaggtgaaattgaagaattcaagactcagaatgtaagtaacattatccagcgtggtggaacaatattgaaaacagctcgttgtatggagtttaaaactcctgaaggccgtaagcaggcatacgacaagttggtggaagaaggtatcgatgctttgattaccattggtggtgacggtacattgaccggtgcccgcatatttgcacaggaattcaattatccgatagtcggtgttccgggaacgatcgataacgacctgtatggtacggatgttacgatcggatacgacactgccctgaatacgatcatggaatgtgtcgataagattcgcgataccgccacatcccacgatcgtttgttctttatcgaagtgatgggacgagatgcaggtttcctcgcactgaacggtgcgattgcttcaggtgcagaagctgcgatcatcccggaaatatctatggagaaggaccagttggcggaaatgatcgaaaatggtttccgtaagtcaaagaacagtagtatcgtactggttgccgaaagtgaagtaaccggcggtgcaatgggggtggccgaacgtgtgaagaatgaatatccgcagttcgatgttcgtgtctctatcctgggacacttgcagcgtggtggatcgcctacggcacaagaccgtatcctggcaacccgtatgggggtcggtgctgtcgatgcgttactggacgatcagcgtaacgtgatgatgggtatacagaatgaccagatcgtatacgtgccgttctccaaggctattaagaatgataaaccgatcaaccgtgatttattgaatacacttcgtgtgtcttccatctaagcatgagtttcagaaataaataaaccccgccggatatcgatccggcggggtttattcgttttaggctataccttatttcttcgataaattctccaggaataaatccatcatccgtttagctgcgacaaacgaactgatctcgttgttcaacacctgttgctctgtcggtatcagcatgccttcaacggccggattatgatagaacgtttcacgtaatgtgtcgttgatactttcatacatccagtactttgcctgttcattccgtttgtaattgaagtagccgtttttcttggtaaactccatgtattcgcctaccatatcccatatttccttgattccgatgttgtaataacctgagtaggtcaatactttggggaaccatccggaatctgcgggcgggaaaagatgcagggcatttctgaactgtgcagcggccaggttcgctttgtcgatgttatcgccatctgctttattgataatgataccgtctgccatctccatgataccgcgtttgataccttgcagttcgtcccctgttcctgccagctggataagcaggaagaagtcgaccattgaatgtacggccgtttcgctttgtccgacaccaaccgtttctacgaatacggtatcgaagccggcagcctcacacaaaacgatcgtttcacgtgttttacgtgccacaccacccagcgagccagccgatggcgaagggcggatgaacgcatccttttcgcgtgataaagcttccatacgggtcttatcccccaggatactacctttggagcgttcgctactcgggtcgatggccagtacagccaacttacgtccttctttgatcagatgcataccgaatgcgtcgatagaggtactctttcctgcaccgggtactccggtaataccgatacgaaccgatttaccggcaaaaggaagacatttttcgatgatttcctgagctaattgttgatgctcgtatttagcactttcaaccaaggttactgcctggctgaggatggttatatttcctttcagtatcccttctacaaattcggaaggggtatatgctttacgttgaggtcttttgagatacgggtttacagtcggtacgtcggctactcccttgtttacctttaatcctctgtaaagatcgtcgttttcgggatgttccatgtttaattgacaatttattatttctcagctgttacttttataaggcgaacagggccattcgggtcattgcataccacattgataagcgcttccagttttgtcttgatttctcgtggacgaaccgaaatcttataagtagcagtcgttcccggtttaatttcttttttgcctccggagatatccaccaattcattatcgcagctgatgctgtggataagaagcggcgactttccggtattggtaatgtcgacagttccggtcactttacctccgatcagaggaataaaactacctttctccggtaatttcccgaagtcgagtaaagtacccgatagctgtgcaacaggagcctgcgccttctctgcagccgataactttccaaagttatcaataatattggctgctacgtgcacttttcctgaaatttctttttgtcctatgctttcaaccgttaaaggtatctcagttgtaacccgtccttttcttttggtcgctttggcatccatcaataaagtaatttcgccgacttcatccggtgccaattgggctggacgaatttctacggtcaggaagttgggaactttaccctgatggatcgtaagagttgtttttccttcgttcttcacactgatcttctcccctaatgtttcatccggacggatactgctgtacagaaccgttttggtctgcatcttcaggtcgccgatggaataagggtaaataaatgtaggctgaagtggtttcggtgttacgtttcctttgatagccagcgtatagctgccttttttaccattgctgaatatggagatcgttttgtagaacgggccaggacgtcctttggggttataggtcacttttacgtttccggtctttcccggggcgataggttcttttgtccattccggttgtgtacagccacaggaagcagttatacgagtgatgaccagcggaccgtcccctgtatttttaataacaaaagtatgactggccaatccatccgcttcggcgatagtaccgaagttgtaggtcagttcgtctgcacttatctgagctccgttctgtgccgctatattagctgttatcaggaatatgcagcatagaataaagcccagtcttttcatattcagcattctttgtttttagtttagcttgttgtaaattaaattacctctccccgtatggtcaggatgtaacttccggttttaccgttgctgtaaactgagatcgttttagagaacggtccgggacgtcctttcggatcgtatgttattttaatatctccggtctgaccgggagcgatcggctcttttgtccattcaggggttgtacatccgcaggaagcgattacgcgagtgattaccagcggagcttcgcctgtatttttaactacaaatgtagtggatacctttccatcggcttctttaatttgtgcaaagtcgtgagaagtttgttcagcagaaataactgcttttttctgagcagaagccattcctgtagcaagcaggattgccataaaaataaaaataatctgtttcattttactttttatttagctattgtttattttacaaagatagagatttagaatggaaaatcgggaattgaaggtctaaatttacaatcggcggatagactgtttgtctgtctgttatgatattcaatctctcaatttcaattcccgactttcgatgtttacttaaccaggattgtctcgctttccgtatgcgaaacaaattcgggagcgtacaggcattgaattgtactgattccacctgcatattctccagtacgtgttacgtaaaccggatattcgataacgaaagttcctgccggcagacggttaaagaagaagttctccgatacgtctgtcggtgactggtaatacattactccgtctctgaattttgttccggaaatcaggtcggccggttcgaaacatcctgcccgcaagtctttcaggaatacataatccatttcacgatccgtgcggatagtcaggcgtactaccactttgtcgcctatgcgaagtttaccgtcggttaccggctgtatctgcaggccggtgccactgttgctttcgatgaacaatttcttttcaacgttgagtacacccttctgtttttctactttatttatattttcgaagtactgttcgtaaacggctccccaggcaggtgcatttccttcctttcggatggaaacggaattgcttccggaagaaatttcttttccgtccagtacaaccttcagataacctgttgccgtttcaccttcggctgtgttgtaggttttacctccccagtcgacggtgcaggtattgttatcattcagccagtcgtttccggtcaataatagggcgtagatcgcattctgtgttgcaggaaccgactcccagttctgagtacgtttctggttcaatagccattgcttcatacggtcggtatctttagagtccggcgataaagtattgaatactttcatcaacaggcagtgcgtatcgatcggggagataaagaaaccgttctctctccggttgttcgcccaatacatgccctgctcggtagagacggtagccgttttacgcaaccaggctaggatttcgctggccacttcctttttaccgttccggtacatcaatagggcaatttctcctttaccgtaaaggttctgtttattccatgttttttcagcctgtgtcgtgtagaaacgaatagcttcgcgggcatcaccctgttcaggaatatccctgtaagaactacgtacgaataagaattccagttgcaatgagttcggtgaactggcctgccactttttatcgacttgttgtagacgtttgtaatccgattgcatctgtttgtccagatacctgagtgccttcatctgcatctctttttcttcttgtccgtattgaacggcacccagctctaccagttgcgacattcctttcaggatatgcagtgtgatctcgcggctgggatagaaacctttgaaccaaccccatgcaccgtcttcattctgttgcttcaacagttgttgcaaagccagttcgcgttgctgggcagcacggttcaggtcgaacaataaggataaccgttgtttctgttctgtttcgttgtcggcagccagtacccacggcgtttcttgaagcaggatatttttcagttcctggttcttttccaggtttgaatacagggttgaagctgttcctccctgggccttccactggctgatcactttctgtatgcgcggattggctgtagcgatatagttagccagtgtgttgctgtaatacgaagcgaaccatgaaatgatattgtcgtttgccggctgcgttaatgtcggcagggcctgtacggcataccagatcgggttggctgtcagttccagtgtcatactgaacggcttacgggttccggtggattgattgccggatacccggatctgcttttcgctttctcccatcaggtagaacggcgtactttccgtaacaagcagctggttcgacagtaccgggatcaggtgttgttcgccatcgctgcctgaatccgagtcggctactatacggattccgatcaggttggttgtttccggcacgcggaatgtccatgaagctgtcgtaatactgtcggctgccagtgtgaatgttttctgcgatttgctcaggcagatcaccggctggtcggttgccggatcaaacagttccagtttcacccgtccggtgatggactctttcgaattgtttatcacttgtgtgctgacggaaacttcatccccctggcgcataaaacgcgggagattcggcacaaccatcaacggcttactgctgatcacttcttttgtcaacagaccgtatttcatatcggatgtgttagccacagcctggaacttccaggtcgtattgctttcaggtaaagtgaattgcaactctatatcaccttctttgttcgtcaagagggaaggatagaagaaggctgtttcattaaagttctcccttacctgcaacattgtttcctgcggtgtatcggctgcgccttcatccgctttccgcgactgtgaaataactgcattttcttccagtacacctccggttatcgttgcggcatcatccgatgcatattcaacagccatagattctgctatcatcggggcggccgacgatttcatcatgatacctccgccataagctctacggtttctgaaatccataataccctgccagttcaaacggtcatactgataatcaggtatattaatacgatcaggccttccggcatcgtacatcattttctgatccataccggttcctgcattaaagaatggaatgttcaggtaaacggaacgttgcggattaaagtaccagttgaacggtaaaatcttatccagtgaagcgtcgtacatgcttgccagtacctctgcactaacgggaacggaatctgcatccagtatgcggaatttccaggtttcctggctacccggcagcagacggtcgcggaaggtcgtcggttttatagtcagacggcgatccggttgccggcgtttgatctgcgactgggtggtgtacaactttccgttctttacgaaggtgaagctggcaacaataccttttccatagttttccaggaatgggatacggaaaagatggttctcgttatttaataccaggcgtttacgtgaaatacatttgccatcctgatacaattcataaaggacatgagcctctttgtcggatgtaccgaacagtatattggcttcttctcccggcaggcaatcggtcttttcattcaataaccatagatgtgtgaataccggtggtcgtttatcttgcagactatataagataaagtcctgttgtgcagtggctggacgaccttttgaatctttagcttccagtttgatacgataacgaccggcagccagttttttgaatgcctctttatcgatggtctgtcctgaaacgaatttaccggctttgacctgctgttcttctttatattcttcttgtccgtagatggtctctgttcctttatcacttaatttatagattgtataagtaccctcgatagttagtttctccccgttcagggtctgtgccgatacgattgcattaatagaatccttgtctatttgtgaagggatatcggtattcaggacgatgctggtttctccgactgagaacgtataggttgcttcctgtgtctctccgttgctgtcggtcagggttgctgttacgatgtagctctgataagggaagaagctgtatccgtttgtcgatttctccggacggaatttgaaggagaacgtaccatcgttgtcgattgttgtggtaccttctgccacctgttcgttcgtgttacctccaaaataaccacgcatccagaaaggctgcttgttaatgcggtaagtcacttctccgctttgcagggaaacgccggagaaagtctttgctttcccttcgatcgtcacctggtcgccgaaagaaatatctcctttgataggtaatagctcgacaaagaaagtcgggcgtttgtattcttccacacgtacggtggtgctggtatactctgtggaaagggtgaacattccgctaagtgtctgctgaggtaatgtaaactcaccgttgaaagaaccgaatttgtcggtcttcaactctttggtagccacttctttcgaattggcatcccgtaaagtgatcttataggtttctccttccacggcgtatggtgtttctgtatcgttgacataagctatacctttaaaataaagattttgtcccggacgatacaatccccggtcggtgaataaagccaattgcggacgggcttttgttttattttgaatgatctgtccgcccggataaacaagcgtcagcattgaagaaatatcttcccggtgtgtagcctgataacccatcagttcgctttggcggggaagaatggctaatccgtcacggtctgttttcactgttcccagcttttgcaggttgctgcgttttccggaatagtaaacgacggcggcatcgcttaccggctttccgctcaggtagtctgtcaccagcacttcagtggaactgttgggcatattacgtgaaacagtagccaggcggcttacgctgaacaggttgttggtctttatctgcgtaccgggcaccgtaatgatacattcgtacaaccccatatctctcatcgggataacaaggcttgtgtcagactctgtgtatgtgttgggctgtgataaagagaaagtgacctctttaacaagtgcaccgagtgcctggctggtatcttttacattataataggttgtctggagaggtgttttcagacttttgtatatactaacggtgatctttggaatattcctgtaattcactttcaggttcagttcttttcccggatagactgtattctccgtattgacgcgtaacaatggattttgcatttccgccaaccggttctttactaggccgatccgttcgtaattcgggaaacgggcaattgtttccttgcaaatattgtattctattgtattgagggaatcctgttttgccggattgttatagtcgccggcagacgtcagtgcatttaaccgggcggcaacgatttctaccgagtaatccttttcggcatacactttctgcaagctatcgagggcagcctggtaggggactctgtccttttcctgataaagggaagggtatttgaacgacaggtaatcaagggtggtaagtaccactgcctttttatccggttgcgtattcagataagcgatcagttcttcgtatatctctgtcgagggagcaatatccagggcacggaatgccaggaaatcatacagggtagggcgaaggaccggagtatctttccccgtctcaaggattgccttgaattcggataccggtgtttgcttcaacaggtcggccggttgcagcgaagcatttagttcctctttgatcttttgggtgaaaagattggaagtccattcgcggatatcttccggaacgtaaccgaccaggtcggtccgctggttgatcttccaccggttctgtatgtaatagcggttgtacatttctgccaccatcgaatggagtacggctgtcgaggccggatctttgcattcggctgcatagttttccacttctttaataagtgcagggaagttgtcctcgttcacttcgagttgctctttcatccggctgatcaaagctttaatcagttgcggtgtgttcttaccttgaatggcttcggtaatcattttgctttcatttttcgattgtgccgctgttgtatacatgatagttgccgacaaacagcagagtatcaatgcggaaacaataatagcttttatcttcatatctgtaatgggtttacatgttaaacaacgttctttgctatatagatacaaagaaagggtaaaaagatgtaaacttattgttaataaggtgtaatagttgaggcgagggaaacaccggatgatagttcagtttatattttgtttttctgaaaacaactatcatactatcatctttttgaaataaaacactgtttgttaggtggttatataatgatagttgtacttttatactgtcattcatctatcataaactatcatattcctatttgaaaacccaacgggttacctcctgttttcgataagtataggacttattttcaataagataacgacttgttctttttgagatccgggtctcggtcggtttgagatccgggtgtgagcatcgtcaacatccgggtctaaaaaggggcaaaaccggggtctcggatactattggtaagcattttcgtgaaaaaaagagaggaactgtcgaaaaaagtcagggaggaaacaaaaatagccaagggtaaatcatgatagtgtgtcaaaagtgccggattgagacttttgacacactgtattgttatttcttacggtgataagtaaggaacgtatacggataagcatgttttgcatcagccgggaattcctggcgttccacttcttcccacatatcccagtttaccacagggaagaatgtgtcggcatccttaaactctccatgtacgcgtgtgatgtacatcttatctgctatacgcaatgcctggcgataaaccaatgcaccacccagaatgaatatttcttcttctttttcgcagatatctaatgctgtacccattgattcgcaagcgaaacaatttacaaatcctgcttccggcaaagtagtcaggactacatttttgcggttgggaagcggtcctttcggcaatgactcgaatgtcttacgtcccatgatcacggcatgtcctgtcgtcaaatctttaaaacgtctcatatcggctggcaaacgccacaacaacttattgtttttaccgatagcgttgttttctgctatggcagcaatgattgaaattgtactcataaacttatcgatttatatagtctgtttatattctattactagttacctaacccctcagaccgccacttctcctttgatgtgcggatgcgggtcgtaaccggtcagattgaagtcttcgtatttaaagtcgaagatactttttacatccggattgatctccatccggggaagaggacgcggctcacgggtaagctgcaactttacctgttcgagatgattactgtatatatgcgcatcacccagcgtatgaacgaaatcaccggcaataagtcctgtggcttgtgccatcatttgtaaaagtaaagcgtaggaagcgatgttaaaaggaacgccgaggaatatatcggcactgcgctgatacatttgcagactcaggcgtccgttcgctacataaaattgaaagaaagcatgacatggcggaaggttcatgttgtcgaggtcgcccacattccaggcactgacaatgatcctccgtgagtcgggattgtgtttgatcgtctcgacggcttcgttgatctggtcgatagaaccgcctttgtagtccggccacgaccgccactggaatccgtagatatgtcccaggttcccgtcggcatcagcccattcattccagatacgtacaccgtgatcctgtagatactttgcattcgtatccccttgtaagaaccagagcagttcgtatatgatagacttcagatgtagcttctttgtcgtaaggagaggaaatccttcttccagattgaatcgcatttgatggccaaaaatacttagtgtacccgttcctgtgcggtcttcttttttgactccttcggctaatacgcgatctagcaattctaaatactgtttcatttttatctttctagtagaatacaaaagtacgaaagggatttgtattaaacaacaggtaatttgtaaaacgatctgtttcagcctgctggtggtttgaaattgaaagggtgtgaaggctatgattatataaatcctataaatattaaaatattaggccggagggataagctaattttggagatgaatttattaatattaaagtgcaggtacgttataataaggccttttcaacctctggttgtatctggcttttctcctatttaacaaatagccctggttttatgtattgcttgataattatctgatatgctgtgatttgaactgactaaaaaaaacgttcctttttttcgttcagcaaaaatacgcattcctttcgaacctgcaacccttttcagaacttttttcacttttctatctgctttcttatcaatacgatatggaaacagggacaaaatagccacttcttgttacaaaagtaaaagaatcttaaacgaatgactagaaaaaaggaacgttttagctcgtcaaatcggcaatcggcgtgtaaaaaggatgccgatatacaggcgtttaacagttccgttaaaatgcttttttcttgtgtcctacgggtttaggtggttgaaataagcggagagaggctaaatgagatcaaaataatcaatttgagtatagatcataattttattaattaaatgttttacgtatgagaaaaagtactttggtaaaaggcgggtcggccgctcttttatgtgctatggccttttatggcttgtctccgatgctgaatgcagcagatccggactatgccaatattaaggctaagtggtatgaaacagtgaacactgaaggtgcgtggaatgatgaaggaggccttattgatggctcgattcatttgaaaccgatcgacaaggtgaacgttcacgatcattgggaagctaattcgacttcttttggcaactatgagtcgatgatcgactttacaaagatggatgcaggtttgatgaatggtgcttttgtgaccttctttaatctggatgcaagcgatggttctaactatctgaagcctttcatcggaaagtatctggagatggcttattcggatattaagaatcacgaagagatgaacaccgccgaatatctgaagttcacagatgacaaaggtaataccggattgggtatttatcagaaccagacggccagttcacgtgtagatttcctatatagcacaaaaggcttgacaggtgttgaaagcgttgaaatggatattcgtgcttttggtaatacagacctggtaaaccgtaagatcgactggacatatgacgtatatgtttatgatctgtctggagaatttgtgggtcagatggttagcgatcgtgcagttttcactgccagcaatcatgaagtggctacagcccatacacatcatattaaagcgcatgtttctgacgccgataatacgaatcctaattcatggcagcagggatctttggacaacaagatgattattgttatgttcagaggtgctaaatcggttgctgatgatgcagtagaatctacaggttcaaagaacacagagccgttgacagtgttcacaaatgcaagattggcgttcaatcgtccgagcgttgctttcggtgctgcaaatgcaaagatatttgaagctggtgccggacgtaatacttcttgtgcgaccgatacattgacaacaacagtagatctgtggaatacattgtataagaacagtaagtcaaacaatgtgtatactgcaaccttcagcggtgtatctcgtgacttactttatacagtagatgaaactcaggctccaaaagaagaactggcatactacgaattaaacgttgagtatccgtttatcgctgaaaagatggaaatatcaaaagaagctaatctggcagaagtagcaggttgggtttctttggatgagatgtttgatgacggtaagatcggtagaaaaggtacaccgggtgtagataagaaaattacttatctgatccctcgtgaattcttcgttcagacagatgctaccgacgatcgcgattgcaaatcaagcgctcgtttcacttattactttgctcctcaagaagtaaaagcatttgaaaaatctaactatatctggtctactatcacagctgaagcttcagatacagctcgttatgcacttcaggctacttctgttcctgaatataacgaattgaacgatctgttcttcgacgaatatctggatttcaagactgcaaaagttagcttcaagaacttgccttatttcaactcattcgacaacggtcgtacaatggatgaactgcattatggtgaattattgctggttaaccagacaaaagctcccagacattcaaccggtcgttatgatgacgatgtgaatatcaaggggtggaagattgtcttcattaatgatcagaataagaaagactctacttatgtaccgggtcgttatcttccgatgacagttcagggacatagctatactgactatgcttcatggttggaagaacatggttgtcctgattgctatattgaagatgaaccggaagaaatcggttcttatgcaacagtaaaagtaatcgactgctcaggtaatatctacccgaacatcgttagcgttaatgctatcttcaaatatcaccgtggtgatgtaaacatcggtgacgacgagtctaaatatgtaaatgaaacatatactatcaatccggctctgacttacgatgcttctatcgcaagatattttgaaaatgacgacgtattgagtggtacaacttatacttataccggtcagaatctgatggataaggtaggtggtgcagtttattcaggtccgatcaagatcttcggtaacaatacattcgtatggttccaggatactgaccagtctctgttaagccacgctatgggcgttcttagctctgaattcctgaaatatttcgaacgtatcgaccgcaaagatttcttcttcgctccttacgacgaatgggataactacaaatatgagtcaagacctcacactgttaagatcttcgcaacaggtttgaaacctgatgttgctggtggtacggttgcttctatcaaggtattcaaagaaaagttctctaaaactgaaagctttgacgatgcagtttatcatacaaatgcgttcatgttcacaggtgcaagtctcgattttgcaaaagtatatgtgaagaaaggtaatcaggaaaaaccgatcgaagaatacgacggataccagtggggtaaatttatcggtatgagcacaggtgatactttgatttataaagttgacctggataacgactacgctgtacagtacttggaagaaaacggtcttgatatgactgttaaatatgtaccttacaacgacgtgaacctgcttccgatcgctaaagaatattgggattattgctgcttcgaaggtactcctaacgtattcaaccacgtagctcagttcggtgtaactacatccaacaagaagggctggaacgagttctatacattcggtactaccgacagaggtttgactacaacaatgaatgcagataagatcatcggttcatatacaagcttctattcattcctgactcagcagttcggttcatgcaacgattgtggtggtggcaatcctccggcacaatatagtacttcaattggtagctccggcgacaactgggttcctgctcctaacctgatctataacgaaatcttccgtaaggattacaagactcgttatgtaaatacttgctatccggtacgcgacggtcagttcatcatctccggtttgaacattgttgatccggttgatatggatgtattctctaacaagaaaggtgctttcaattatgaagtaacagttcttgccgacctcaatggccaaccttatggtaaagttgatacggtaggtacgacagttcagatctctccgaacaaatacggtgaagtattggctcttgtttctgctaagttcgatccgaaagatcgcgatggcattgcaatgactattgatacaatcacaagtggctctgaaaagggtatgtgggctcgctactatgcgaaagactctatccgtctggctccgcaacagcatgcttctgacgttgaaagatggaatcgcgtatacttcttcgacctggatgattacaaacacattctgtcattcgaagatgaaaagtggaagaaattcggtatctgggctccttacggtgttaatattaccgatacgctgactgcttctatcaagggtgacgtgaaagttcctgaagtatggtatagctctgacgctgctggtaagaacaagatcgatgcattccagttcggtgttgtaaatggtggtacttctaaagactcggtattctatatccagggtcgtgacctgcctcattacggtactactgtaaatgatacggatcctaaggtagaacaggaaatcaatgtattgagcacttctgacttgttcacattcggaacaaacaaagctaaagaagtgaaactgttcatccgcgaaaaatctatggaactggctgctacggctgctgatgctccttacgaattcaagggtgctgaaggtgacttggtgaacaatgttcttcgtggggacgtagctgctaagatcgctgttcgtgcaactccgaacgtagaagatctgtgtgacgtagaaaatgcactgtctctgtcagctgtatgtgacgttcagaagaatctgccgttggcattcactgccggtctggaaaaaccatatatcaaagatatggaaccgggcgacgtaggtggtagcgacgctcgtattaagtggacagccactccgggtgctcagtactatcaggttgccgtaggtcgcttcactccgaagttcacttctgaagacgtatttatgtctgaagttcgtgctgacgatgcaagcaagactatctgggttgaattgttcaacgcaacaggagatgttatccaccgtgataataaagttaactactggttggaagtaactaaagaatatactgatgctgcaggtaaacctcagaaagaggtaactaaggtaagtgtagacaacttcgaactgcaaggtaatacgcaaccgatcgacagaaactgggggtatgctccgattgcccaccagatggacaacatggatctgacaacagacatcacgaaaccggttaaatatacaatccgcttgatggaaggattccagacagacgaacaccagatcgacatttatctgttcgatactcctgcaacatggatggttagaaagcctgttaacggtatgcctatcaacggtggtgcatttaacacaggtgactggagaactgaagtaggttcattgcctatggcatattacgaatggcaggatgatgtcaatttcgacggtgaagaatcgttcaaggttgctgcaacatccacatcgatagctgttcataacttgatcccgcagacagcttacactgcacgtgttcgtgcattcaatgagtgtgtcggtggtgaagaaatgattccgtcagaagacttctatgacttcgctacatctaagactgctacctctactggtgacatctacttcgatgacgcagaagaagtgggcgtatccaacgaatctatcaatacaactgctgtaacagttctgggtggccagggtaaggtaacgatcctgaatgctgctaacaagaaaattgtcatcagcaatgtattaggtcagactattgccaactcagtagttacttccgacaatgttacattcgacgctcctgttggaatcgtagttgtaacaatcgaaggtgaaacagctgttaaggcagtcgttaagtaagacaatgaataactattgatataaagaagtttataatcaataatttctaataaccgcgtggcggatgtagagacgttgcttgcagcgtctctacctaataccaattaacctgcgaaggcgaaaaggcgggtattaatactaaagtaatgaaatataaattcttccgccttagctctgtgaagaatgaaagcggatacaaaccctggcggagttttcttttgtcagggtttgtattatgttttatacagacttgattataagcacttactgtctattgattgaagtattaactaattaaaaaaattgcgcatgaacaaagtatacttaatcgatgtgagtaggcgactacttatattcgttctattattgggagggtatatcacacaatcagttgcagcagacatttatgtccccgtgaaagatgtcctgtcggtttatgaaggaaccagtgacgcaaatgcagaacaactaaaagcccatatccaaagtttattgcaggaagttgttgaccttagtgatcagacagcgacaatatccgatgttactatcagaggagcaggtggcgatcagaccggcgatttagtggccggcagctataactacactttcaaagtaacttctagcagtactgttacattaaattttgaacgggcgatcggaacagggaatattaaccctgccactcttttcggcatacttgatcatgagtcggttgtcgtaacaaatgctatcgagatcaaagcccgtcaggctgtcggtaatctgaattttccggcaaactggggtaattatgtgtatggaacgcctgtcagtgacctgaataccaaaatacaggtatcaggtatgtccggagtatcattaactgatgcttcggttttcctggttaaagacggtgtggaaacactatatacaggcaataatagtctggaagcgggagaatatgacgtagtacttacgttcccgccgactgaacagtttgcctattctccctctctgagtaactgtgcccaacaagctatcggctcttacatttctacagcaaagttgaaagtaaaagagaaaccgatcaataataccgtatttcctgtatttgcagaaggtgtaggcggccttggcaagatggctgcaaacacgaatctgaacagggcgaagaatcagatcaataacaacattaatccttccgactttatctctgagataaagatctattccgatgccaatttcagcaatgaagtaacagcgggcaaactggcccctggagttgtatacagctatcgcgtcgtgcttctgccgaattatggtaaaggaaataatgtgtcggccagtgttggaggtaaaacgatcaacttcaatacagcacagcatagttatgatatcgtaaatgcaatttcggttgagaagaatacgttggcagtaaaattgccggacttcatttccagcccgatccgtatcggcgactatagcgataatgctgcgatggcaacgatgctgaaacaactgatccaggatatcaatccggatatggtcgaccagaaccttgttccgaaggtggatatcaccgacggtacggtttcttcttctatgccggacaatagcctattgggttacaaggtcgctgtacaaggtgatctgacaaagaccgatttgaattttgtaacgaatggtagtgtagcgtctacaaacctgactgtcaacggaaatgtttgtacgttcaagaattcactgctgttcgtaactacattgcctacaacccattctttggcttatcctggcaactatcagatcgactacgaaaaagatatgcttccgaatgcggttatccgccgtatcaagagcgacgtactggttcgtaatgcaggtgtattaggaaatgaaacattcgttgttcgcctgatcaataatgacctgagcaataagaatgcgataactgaaacagatgattcgttcggctataagatcattatcaccaagagtgctactttgcaggaaatagaaacaccggccaaccaacggatcaacgtggttgataaaggtacgactattgaaatcacttactcgagaagtatcgctatcgttcctcgtccgactatcgacttcacgttcggcgaatataccgttcaatatgtgaaaggcatgacgcgtacacaagtagcagataaagtacgagacttcatctatctggcaaatccgtttattgcagagtatataactaatgtacagatcaccaataaccggatcacggaaaatatgggtacggctacttaccgggtaacgttaagttctgacctggatgttctcttctcggaagtaaccgtgaacggacagccgcatagttcgacaacatttgaaggtactgtaaacatcactccgcgtccgatcgcaaaagtgaaactttataagtatgagttcaagaaagatggtgcatccgacgatatgatcgaaaaagcgatcctggctgacctgcttttgaagaacccggatatgaagggggcctatatctccagcgtaacattagttcctgccatcggcagagatctttattcgtatactgtcgtattcaatccgaatgacaatatccggaagatcgaagtatctaatgaagacggaggtctaatcattccgatagaattattcggttatacaacggctacttaccttcgctcggtacgattaaccgacaacggtcagtcgctggcggaatacccgcttccgatcaatgtgcaactgcctctgtgggaacgtccgttcggacagactgccgacgagtatgcacaagacttgttgaatgatttcagactgactccgggtgcagaccgcgtaacggttcctgacctgaataactggggtgtgaaaacatatctgatcaacaacgaaacttctacgggagatgttccggtgcgtattgccggtgaaagttatccgcaggtatccgacctgtatggttacgaagtggttgcaggtgctaatacccagttctctgaatactatacattaaattatacggcaccatccagcattcacctgaccaggaacggtaacgatgtgattgccaaattggctctccgtatagtaaaagcaaaacgtacgcttattttaccggaagtgaatgtcacttacaatgacatcaatacgaaagtagctttacttgactccgtaaagaaagcagtactcgaagatccggctaatgtagaattcttcgaactggtagctaagacaggtgttaaacctttgaagagctttacagttactatcaataatatagaagaagaaggaacaaccgttgccaagacttatacttattcggtagcattcgttcaaaaggtaacggataatatcgaaataagagaaacaggtccgaagacactggttgtcggtcaggctccggttgtctttacattcccgacagatattacatatcgttatggaaaacgtaaagtggctatcgaagctgacatcctcggtcagttcctggcggctaacgaaggtttgttaagcgcatatgcttgtttcgaaaatccggcggacctgttcaaggtgatgttgactaatgctgattgttcagctgaagaaacagaaacgttgccgaagaacggtgattacggttacagagtagatgtacttgatccgaacctgttgtcgaacttcctgcttgacaaccaattcggcagtaactgccataatgtacagaactctgttcagatcggtcagcgtaaactgactatcacactgcctacttatctggccgctacagccgaagaagaaacagccgcgaaagctgcatttacattcggtaaagcgacaaaggcagagatcgagcagatgatctacgatgatatcgttgcattgaatggtgcgaagatcaagagtgattatacattggtagtcagcctggttgctaccaaggcgcaattggataagaataatcctgtaattggcgactacaactataccgttgaactgacctcagccgattatactttcgtttatcagatcgaaggtgctgaagtgactgacggaccgggtatggatgtcgttactgctgtcaacgcagtgaaggtggttgctccgggtgtcgttgtgatattcagcgaagaaaaactcgaaggtgtctggacgatcgtagccggtaagccggtatatgaactgaccaacctgacactggcaagtgatgattatggatttactctgatctctattaaggaagatccggagaatccgacaccggccatgacgtctgcacgttggaaccagttgtttaagaacaataagttacattgggcactgtaccgcaacaataaacttcagttccacggtaatacattgaacagtgtcctggtcgactctgtaaagaacaatgtaacccagggtaattataaacttcgtatcgtagatgcttcgacattgaaagcggctatcggtaacttcgaaatccagttggatgctgacctggctaacctgaaggtgactccggcaacagtagaagtgaaagcggctaaagatgcttatacaaaagtatatggcacagtcgttactaaagatgccgacctgaatgcgaaacttgtatttgcaacagaaccgaagctgaatgcagctaaactgctggcagaaaagaatgtgatcgacttgtttgaaacggtacatccgctcgatacagacgtttatgaagcaactgccccgataggcgactaccagatccgtgcaatcgatgcaatggtgaaagaactgtttactccggttatcggtgttaagtttgcagcaagtgaaacggaggctgaagtaactgttactccggctccgctgacggcaaccgacttaacggttaaagtatccgttacacgcgaatatggcgaagaggcaacagatgccgatgtatatgcagaagtttccggcaacttatccgaagccttccaggctgagattacccaattgctgaatgcagataaagtaaaccgtacaagctggctcgacctgtcgggcgtaaacaagaagacagacgtcggtacatacgagttgcgctttacatcttcggctgctgcccggatcgcagccctgcttccgaacttcgatatctccgctgctacgcttattaatgcaggcctgacggtaacgccggctccgctgaccgtacgtgcgaagagctataaccgtccttacggtggtggtaacccggatcttgaaatcgaatacatcggtttgaagaataatgaatatgaaaacctggcggatgtattctctgtgatgccgaagatcgcgacagatgcgaaatccgactcacgtggtacatacgatatctacttcacggtaaaaggggaagcacgtaattatacggtaacccacgaaaacggaaccttgtcgatcgataagatccgccgtacaatcatttggccggaagatcagcgcaacctggtaatcccggtaggtgaaacagttgaattatcagcctacctgaaatcggaagccgacggcaaaccgtctatctatgatatccgttacgaactgtcgggcaacgatcgcgaacgcgtgatcctgtctgaaacagcaagaggcgtttatgctgtaaccggtaatgtacgtacggaaggagacaactatgtgaccatcacagtctttgccgatggcgatgatacctacgaagatgcaacacctgtaactggaacgatcaaagtaatcgctccggaaggtgatgctgccaaagtaaatgtaattgtttctaatgtaaccagcatttacgacagcaacccgagagcagtaagcgtgaaggtaaccgacgtggaaactggtgaggctgtgaaagacttcagcatctattacgaaggtgaccaaatgggttctgttccgaccctgtatccgtctacccaggatgctccgacagatgccggtgtatatattgtaacggtgaaggctacgctcggttctgtcacttattcttacacagctaagaacaagatggtgatcgctccgaagccggttgtggtaacagcccgcagcttcaatatccggtacggtaatgaacagcccgcttacgcgaatgcatacgattataataagagtgacttcctgaacggcgaagacttcctggttggccaggctccggttgtccgtctgatagcatacaacggtaaagccggttcatataagctgactccgtattctgctcaggacttcggtcgtaactatgtgattacttatgtgtccggactgttgaatgttagtaaagctgccgtgactatccaggctgataacaaagaaacagtttatggtaaggatctggaagaactgacctacacggctaccggcttcgtgaatggtgaaacgctgaaggacctcggttttgctccgcgtatcagttcgactgtaacacgtacatcggatgcaggtgtttacccgatcactttctctgataattatacatctgataactatgaagtctcttacgtagacggtaaatacaacttgcaggctgcttcacagaagatcagctggagcccggaaactacaatagatgtagaaggtggtgatgtggttcttacggctactgcttcaagtaaacttcctgttactttcaattcgtctaacgacgcagttgcttatgtaaaccagattggtgacgcatggatactgactccggttacttccggtacggtaacggttacagctatgcagcatggtaataaaaactacaacgctgctgaacctgtggtgataacattccttgtggatgatgaatatctctcggtaggcaatgaaaacctggtcgttgcagaccggatcgatgtatatccgagactgtttaccaacactgtcacagttgctgctccgtctgaaatcaagcaggttgaactgctgtcgatgaacggaacattacagacagttattcgcaaaccgggatctgttattgatctgtcgacatttggatcaggcatctatctgctcaatgtaacattggaagacggaaccttcaaatcagtgaagatcattaagaagtaacctgtaaaactaatttagtatgaagaaatatattaaatcaatattcacatcgaggaagcagcttgtgctgcttcccctgatgcttgtttcaggcggtatcatgcaggcgcaaacggctgcacccgatactgtgtacgtaagcttcaatacgaatactgcgctgacgatgacttatggtgacaacctgagtacggctgccgcgggtatcagtggagccagtttcaactatttctatgtgaatggggatggaagtgaatacggaagtatcggctcaggagtatcattcaagtctccggcacaagcgatcgacatcctgaagttttcggctactccgacagtgagcggtggcgagacattaggtttcgtggccaataacctgactgaatatttccaatataccagtccgaatgtagtattctttgtcagcaaccgggccggtgcttttaccagcctgcctttaacggtgaatccggctacattggatatcgcagcccgcgacaccagccgtttctacggtgatgagaacccggcaacgccctggtctgccaaagactttgtgttcagcggttttgtgaatggcgatacggaagcgatctttaccaattcgcaggtgaatgttttaccggacgttacgtatggcggagcagataaaaactcggctcccggtacatttgtaatcggtatgaccggaggacaagcagccaactatacactgaacctgcaggtctggtcggatgcctggcccgatggtagagggttgctgacagttaagcaagcccctcttaccttggctgtccccgacagtgcccgtctgtatgacgatgcaaatgtgaagaatatctccggaaaagaacttctcatcacagacggaactttgaagaacgaccagacacttgaggctttgttcggtaatatcaaattcccggttactcatacagcagtttccggtgcattgggcacaaccaaaagtgatgtaggaacttatagttatgagttgaatgcaaatgcagctaacacggttgcaaccactctttctaactatgatatcctggcaatcaccgccggtaaatacgaagtgaagaaagacacaatcactatcaccgtattcccggcagaagtagaagtcgttatcaacgacaagccggttaaggtgatgcagaaggtgtatggtgaacctaatccggatggttatttctatctgactaaacgtttggaagaaggtagtgctccttcgtatgctttctcgaaagcagctgaggcagtcgattatatctccgcaacagccgaaggcgacaaaggtttcaaagtggctccgcttgccggatacttcgattatgaaggacgcaaggctactgaaaagaccgaagtaaacctgaagcgtgagaaaccgaaccagaaagaagacagcctgtatgtcgccaaggtggacaatgcagacaaagtatcttctctgaactacgctttcaaaacagtagacggaaccttcctgatcaaccagcgtccgttggccatctggaaagtgatcgtagaccgcatatatggtgaagccgataaggatacgacctggactttcgaaccgaacgatgccgaaaagaaacgcgggctcgccagcttcgatgttaaatatcagacaacaactactcctgacgacattatcgacttcatgccgaaagtagtcgttaagccggttgctgccgataataccctgcacgcgggttcttacaacgacaccctgcatatcaaggttattaccgaaaataaaacaatccaaccgccgtatgtggcaaaggatcgtaactataagctgattatgaacacactggttccgggcacaatgacaaacgacagtgtacgtctcgaagttgccaaagctccattgattatccgtctggataccatcaagagagcattcggttcggctgatcctgagttcaacaaagcggaagtccagaaagagtttatctcttacgaaggcttcaaattggatgaatcggccaatagcctcgactcgacggctaccgttgctgtcggcaaccgtatcaagaacctggttatcaacaaccgtccggaaggaattctgccggtaggaacatacgaactgacaggtattaccgaactcaacaaggtaaatccgaactacgaaatcaccatcgtaggcaaagcccgttatcaggtatatccggataatagctatgtaatggtttggacgccgatacagaacgaactgatcgtgggcgaccttgtacgtttgaatgcagtcgttaaacaaggatcgaccgtaatagccgaaggttcccggatcgtttacgaatcatccaacccggctctgatccaggtagaaaaggtagaaagtatctggtatctgcgtgcgaaagcattgacaggcgatgaaggcgtaacgatcactgcccgctacaatgcagagtccggacaggaagaagccttgaagtcggaagtgttcaaagtcttgcgtctgaagaatgaagcagacttcaacgtgatcctgggtaacatggtattcgattacgacggaaccggcaaagaagccgatgtgaagctgactgacctgaagggtatccagacatatactcctatcattacttataacggtgatcctgaactgccggttgcggcaggtatctataacatctccatcttcgtgaaacataacggttccgacctgcttgtccgcaaagaaaagatgcagatcaaaccgcgcgaagtaaccgtgaaaccgaaagatgctctggttgcattcggtgaagtaatgcctgaatcattcgaatatacctattccggatttatcggcagcgacgatttcaaagccgcttctgctcctacggtaaaagtggcaggaacaataaccggtgcaggaaattataccctgtatgtcgaaggtggcgatccgggtgacaactacaccctagtaggtggaaccggaaccctgactgtttcgaaagctacactgacaatcagtgccggtacggtagatatcgtttacggtgatgagatacctgagctgaaaccggtatacaccggcttcgtaggcaacgacaacccggatgccctcaacttcatctacacagtgaagaccagggttaaccctgtcaacgcaggctcttacgatcttatcatcgactgtctgagctctgaagaagacaactatgccgtgactttggttcctggtaagttgaatatcgcaaaagcagccgccggccttgaatggtctgtcgagtcaacatcgatcaccgttggcgactctgttctgttgtatgcttcctgcgaatctccggcaacaatctcttacacagttgaaaacatcgctgtcgcaggtacgagaaaccatatcgaaggtgtgcatgtgatcggtaagaacgaaggtataacgaagttgtacatcacaattcccgagtcgaccaaccacctgtcacatcgtgactctgtcaccttcaatgtgaagctgggtacggtaggcaacgaatcgatcaccctgcagggtgtaggtctgtatccaactttggtagagaataatgcaacagtagtttccgaatctcctgtagatgccatcatcgtgatcgatgcagccggtagagtacagaaggtaatcaacaaaccggaacaggtagtcgacctgagccggttgcgtagcggttattatctggttcgtatcgttctggataacggcgaagcgaagactgtccgtattattaagaaataatcctgttttgttcccttttcccccttaagggaatgaactataaggagaagctgttccaggcattgtcctgggacggcttcttttgttcttataaccggtgtatgcatgcgttgtatggcgtctttcaaccctctttcatttaagactatgacaactaagccggaacatcactacatgtaaggtctttctatatgatagttaaaccctaagtagcctacattaaaaaaagtaaggcactaactgcaaatatgcaaggcatgctctacaaaaaagtaaggcttgccttacatatttgcaaagcatgccttactttattaaaagtcctaagaaaagccattaattcccacgttctcaaaccttaaagataatgatgaaaatgcttagttgtaaccatcttctgaaaataagataggaagtcgctggaaaacagttagtatcgtactgtgtaatatatttaaatgtacgtgcgtacattaatatatatactttgttattttcctataatataataagtgattgttgattgtttacaccttgaaaagcaatatatttatgaaatatattaggtgactagaaaaaacggtcgtttatttccgtcaacaaaagtaagcataagttttaaacctgcaattcttttgataattttttttccctctctatatgctttcttatcaattggatagaaagataagtatgaaattacttcttttcatgacaaactcaaataccccacctgatgatggcgataataaacgaccgttttttctagtcattatatataattcgcccataaaagaagggctgtaaaggagtttttagtaacactattattaatattaaatttattgattatgaacaaaaagttttctacgctaatggcaacgggcctacttctgtcaggtgcgttgtgcggtaatgtgaacgcggcaaaaaaacatgtgataaatgatgttgctggtttacaaacaatcgctccagatccaagcaacgcttctagagttttaggaaatgatgttgctgtaggggatactattttctttgcaaaagatatagtatttcctaaatatacgattaatggagataagaatcatgactttctgagaattaacaagaaaggaattgttgttctagctgacaaaggtgttaaagtaacagggcactttgatattgccgctgatgaggttacaataaaggggctgaatattgtaaataactcaatcggttatttggttcagcagaaaacagctatttatgtaaatgcaagtgctaaaattcatgaaggagagggtgatgctattactaaagtaactgttgaaaataatactattactcaaggaaccgttattgaagatggtatgacttacggtatttttgttaatgcaaataaagctcaaaaggccgcattcaatattacaggaaataccattactgctaatgctttcgccaagaattctaaggatgccaacggcaaggatgcttcttataactcagcagctatcgcatttacagaattagctagtacatctcaggatgtatcaaaaatccttgcaaagaatacatataaggattgtgcaattgattatttggatgaaagaccaactctaacgaaggctgctgcaacaacttatgtgaataaggcacaagttacttatgatgcaactcgtccggaagcagtagttgaattagctagttattattcagaaaatagtaagtcattggttgttaaaggcgctagtgctttaaatgtagtttctgcgattaatgcggctgatacaaaaacagctgttccagaggactttgctgttgtggcaggtaatgtaaatgttattggtggtacggctgctgcattaaatccttcattggaaaatgttgtattaacagtaacaagtgctggaagtgcgaatgcaaccgtagctgttgattatactaaaacagatgacagtcttgcaaaggaatacaccgcaacagaacttaacaaaattctgggcgatggcttcatcttaacattaactgatgtagatgacaaagctattgataatggcgatgttataagtgaaaagttactgactgcaacaggaactactagtgagtttaagttgatgtcaggtaagaaatatttgactgttgttgctgaacaatggggtaatattactgatgctccttacaaagtaaaatttgtagacaaagaagctgatgctactgaatttaaaattacaaatgtagatggtaagttagctatcagctcaaaagttggttctgacaatgtttatttgacagtcgtttctacagatttaggcacagtattgactgctgttaagtctgatgttgttaagactgatttgactgctgttcttagcaaaacaaacatggttaacggtaaggttgatgaaaagaacaacccgttgttaaacaaatatgtaacatttactttcgcaacagcagacaagaacattgctgctaaagacggtaaagtattaggtcttgacaataacggtggaaatgcaatggatttagttgctgccgacagatatctgcaatctaaaccggaaggtcagtgggctgtaactctggaaaatgattcagaatacaacttcaagttcacaaaccgtgaaaagaatgtttctttctctgcttctgctctgtatctgattgatgctaagacaaacaaatatgcagttgtttataatggcggaactagtactttctctggtggtgtaagagatactttcgttatcaatggtgttgatttgaaactggtttctaaagattactatgtaaactacaagaacgacgaaatcaaagatacacagtataagatggctatcgcttctacagaaacaacagacttctatgtaactgaaaaccacgaaggcaaacacttgttgggtcttactaaagaaactgctaattctgtaaactggaaagtcgttgctacaaaagatacagttcttttgatcaacaactatggtaaatatgacgaagatggcgactatgtagctcagcctgatacaatgaagatcccgacttatgcattccagaatgttgctaacgatgagtatatgacttatgctccggaaaaattagctttggacgaagatgctatgtattgcgatcctaactcagttaagttgacaaatgaaaatgatctgtctgcttatgcattcgtactgaagaaaagagctgacggcttgttcaatatcatcggtatcaagaaagatggtgataactatgtattagatctgagcaagaaactgttcggtgcaactactgaaaagaatggccaggttcaggttgaagaatcatgggaacagatcaactctaacgacttgttcaaattgacacctgttgacgctcctgaataccacttcgtagaaaatggtttcggtgaaaaggttagcatcttccgtgaagaaaacgatgctcaggtattgtatgaaaaacgtgatattaagtctgttgtagacaacgatacattgagcttcctgaatattgataacgtttatcagttcgacaagatcaatccatctatgtttgttgatacagcttatatcaacagaggtgaaaacactcgttggcagtatttgttggctgtaaatccggaagttcataaccctgatacttgtacaatcccgggtcacccgagaaatgaccgtatggtaacaggccgctacttgatcaacctgatcgatacagctaacgtatatggtgcaactcacctgcataacaacccgtacatcaacagaacagaagctggtgaatatttggctaaactttcgttcgtagatgcaatgcatattaacgatactctgatcatcaaccgtaaaggtggcgaagctgtaaaactgtttatggatactcctgacttcaatgtagctaagtttgcattccgttatgtaaatcctgccagcgaatcagataagacattcaagatccagactcagtataaagattataagaatggtgatttgactgctaaagacaatgcatctaacgaaggttacctgaaatggatcaacggtacagtagttgttgttaacggttatgcaaatggtgatgtattcggtatcaacgaaaacgaagaccgcgatgcagtagctaacgaagacgttacagtatcttcaattagtgttgtagcaacagacggtgcagttatcatcaagggtgctgaaggcaagaaagttgtaatcagcaacgtacttggccagacagtggctaatgcagtaatttcttctgacaacgctacaatctctgcacctgccggtgtagttgtagtagctgttgaaggtgaagcagctgtaaaagcaatcgtaaaataagcaattatttaaaatcaaataattctaaattgtttaccgcgtgtcgtaggggcggttcgcgaatcgcccttaccccaattaccctgcgacaggcgaacaagcggtagatattaatactaaagtaatgaaataaagttcttctgttctatctctgtgaagagcaaagacagacaaaaacaaacctccctggattatctccggggaggtttctgtttattagcgcaattttatcttaacggacacaaatattattcagagaaaagtgtatatttgccctcatctgtaatgaaaacactttaaattattaattttcaaatgaagagactatgtatggctgtcatggcaatgtgtttattgctgtcgtgcgccgaaaagaaagaagaggctacactctccgggttattgaaatctgatttcgtgtcagaggtagaaggaaaaccaacagcattgtatgtgttgaagaataaaaacggtgccgaagcgtgcattaccaattatggcggacgtttggtttctgtcatggtgcccgacaagaatgggaaaatgaccgatgtggttttaggttatgataatgtggatcagtatgtgaaatctgatggtaactatggtgcgctgatcggacgttacggtaaccgtatcaatcaggctaaattttctttggatgatacagagtatacgctccctgcaaatgacggcatgcattgtctgcacggtggtcctctgggatatcatacccgtatgtgggatgcaaaacagttgaacgaccagactttggaattaacttatctgtcgaaagacggagaagcaggtttccccggaaacctagatataaaggttacttatactttgacagatgataacgctgtcggtatcaaatatgaagcaactaccgataagaaaacagtggtgaaccttaccaaccacagctatttcaacctgtcgggcgttcccggttccgatgtcctggatcaggagatcatgatcaatgccgacaattatactccggttgacgaaacattgatcccgacaggtataagcactgttgctgaaactccgctcgacctgcgtactccggtagctatcggccggcatatcaatgaacctttcgatcaattacagaaaggccgcgggtatgaccataactgggtgttgaactcaaacggtgataagaacgtactggcagcaaaggcctattctccaactagcggtatagctttggaagtatacacgaatgaaccgggcatacagttctatacaggtaacttcatggatggaaaagataccggtaaacacggtgtattgtatccccaccgcggtgcattctgtctggaaacccagcattatcccgactctccaaatcatccggacttcccaagtgttgtgttgaatccgggagaaaagtatgtcagcgaatgtatttataagtttacagcagaataactcagttataggatatacggatagaacaagtctgtctgttgatgcataaagggtaccgtttacggtgccctttttttgtagttaataattctttgcaatcaatatattttattgcttttcgctatctttgctccgacaacatgttggccggacattgagtttcggctcttcatcagttggcaacgttaagcgtttaagatattatctttggaactgaaaatcgccaagtttcaagtcgaacaaggataataggcaactaaacgctcacgcttgttatatatattcatgtatataatagggcgtgggctgttgtcttattatttgttcgatgggtgtttggcgatacctcagttctgaataatagattaacagtttccacgcttctttataatataaaatgccaaacgagggaaacggggcggcacagagttagaatatgaatcctaaagaaaaagaacggattgctgtttgctgtgttttactggatatcgccgaaagtataggaggcagtgttgctatatccgattgtcctcattataaacagctgaaggatagaatcgtcctgacggaacaggattttgaaatggcccgcaacgcatctgtgttgacaagtttagcggttttgaagaatgtacattataacacaaagatgatgctggccttagctgtctgcgacctgtattccgaatacatggttgttccgttcgactatcgtgttgctttcgaaacattgatgaacgcgatagattggcctatctcattctccgaagttctggcacgaagcagaacggaataacaatcgcagttagaataaattatagtttgttcgaagtaccttgaactctgtacgacggtttatctgatcggccatttcctgttgttcgggagtgagcgtcaggataaactcttccgtcaaaacatccccttctttcaaaaagtcgaaactttttgccagtttcttattgattgtcttcggcacgctttcaccatatcctttggcttccaggcgttccttgtcgatacctccggcgatcagataatcgacaacggactgggcacgccgctgggcgagacgttcgttgtactggtcggttcctttacggtcggtatgtgctcctaattcgattgtcacattcggattatcattcagcatcttgatcatttcatccaatgctttttgcgattcggggcgcagggtcgccttgtcgaagtcgtagaagatattatcgatcactaccggtttactgatcggggagaggtagaagtcgacgatataggtctcgtttttttcttccgggcctgtcttcaattcgaaattctggttgaggtaaccgcgtgcactggccatcattacgtaacggatgtcgcgttccagttctacccggtagctaccgtctttctttgccggaacttttacattcaggccatctttaccgacaatgcgtatggtggcgtcttcgatcgggtattcatccacgtccgaaacgagtccttcgataaatatagtgatggttggcagttcgaatgaatagaggtggtcgtaaccgcgtgcgtcgttgcggttggagctgaagaaacctcgttccttgtttccttcgaaggttataccgaaatcatcacccattgagttgatcggggctttcaggttttccacatgccacttgccggtactgtcctgggtggctttgaaaagatcgagaccgcccatacccggatgtccgttcgatgcaaaatagagcgtgacggagtcgcggacatacgggaacatttcgtcaccgggagtattgatctccggtcccaggttttccatcgggccgaagtcgctacccacgagtctggaacggaagatatcttttcccccgaaacctccgacggcatcggatacataataaagatatttcccgtcgggagaaacagacggatgtcccagggcggttacggagtcttttacgatggatgcgcgtgttccttttccccatttggcgctgctacgggtggatacgtatatttcagaggtacgcggtccttccggatcttgtgcgcagtaggtgtaatacatggtgtttccgtctttagagaaagaaggtgttccttcatcaaattcggtgttcacttcatcttccagttcgataggagccagccagttaccttgttcgtcttttttgaccaggaagaagtcattatttcttattccggtgatggcactgaccgtttcctccttatctttcccggctccttttggggtacgggaagaggtgaaataaagctgatcgtaagcctctccgaatagcatcgggcagaattcaccgcggcgggagttgaacttctccatacgtttaacggtgtaacgggtggggttctgtttccattgcggagccaattcgcttcctttgataccgttcagggccagttcgctttccgggtttagtttcagaaactcgttatagtagcggattgcttcggcatacctgccgcttctctggtacatctgtcccaggcgaaggtttacaatgctgtcgggatagtcgtagcgcagtgcattcatgtaggcacttgtcgctctcggcgtattgttgataagccggttacattcagccattcgataggcaatatatccgcgtaggtcccgcttctggggagaagttttcgtataaactttccggtaaatggctgctgcttcaaagtattcaccaatgcgttgcttctcctccgcatcactcagtttggctgatttacaggaaaacaagaagaagaatgtaaaaagcccgagtatataatagaataatgttttcagtttcattgctatatcttacttctaaaaataacgtaacagagtaaatcttattgcgtgaaaaggtatatttcatttaaaaagaattatatttgtctctaataaattattaaaaccagatactatgttgaataatacaaatgagataaaaatggaaaaccagccggtagactgtgttaccataaagaaagaagttgatgccgattttattgaaaaggtaaataccggattatatgaatctgcattaggattagtaaatacaaaagaagaagcaaagcagaaattatccaaatggttgtaataaaatggactaattttgctatccaaaaccttaacgatataggagactacattgaacaggatagctgtaggcaggcggcttttgttgtcaattatttatttgattcggttgatattttggggcattatccttttattggtcgaatggttcctgaatttcaggtaaaacaatccgtgaacttattcgtttgaaatatcgtatagtttatctggttctgaatgaagaacggatcgacattcttaccgtccatcattcagctagattattgcctgatttaccgatactttataggagaagtgaactatccccgtaactcaggaaacggaaatcgttagcgagtgcataatcgtagatattcttccagtcgcctttgacaaaagcggagataagcagaagcaaggtgcttttgggttggtggaagttggtgacgatacctttgacaatcttgaattcgtagcccggggctatgatgatctgggtggcggttaccaacgtattcaattgatgcttatccagataatccaggatgttttgcaatgcctcggcgggtgtcagccggttattggattcgtcgtatggcatccattgtttgacaaccagttcgtcggaagtagcttccgggttagatgccagtgcaacacctatataatacaggctttcgagcgtgcggacagaggtcgtgccgacggcaatgatcttaccgatattctgcatcacccgttcgatggtgcttcggcgtacggaaatgaactccgtatgcatctcatgtccttcgatcgtctcgctttttacaggcttgaatgttccggcacccacatgcaacgtcagttcttcgcgaccgaacccttttgcatccagatcggccaacacctccggtgtgaaatgcagtcctgccgtcggggctgccaccgaacctttgatcttggagtagactgtctggtaagtttttaggtcgctctcttctgttctcctgtgaagataaggaggaataggtaactctcccgcagcatcgagcacttcggcaaagctgaatccaccatcccacgtaaaccgtatctgatgcgtctctccgtaactctgtactttttcagcacgtagtgtcaccttttgtccgttgatctcgatctcccggctgaggcaaggctctttccacttcttcgcattcccgatcaggcagatccagcaacaagtttccgtctccaggaagatccgttcataatcgtgcggctcggaaggatcgagacagaaaacttctatctgcgctcccgttgcacgttggaacagtagtcgggcttgtattacgcgggtattgttgaagaccatcagtgaaccttccggaagataatccgtgatctgtttgaagatactttcgctgacctctccgttgcggtagagtaacaatttagactcatcccgtttcggcagcgggaacttggcgattcgctcgtcgggcaacgaataattgtaatcttcgatacttatctgttgagtttttgtgaccattgcattcattattacggggtacgatcttaccgaacccggctgcaaaagtacaaatttgtatgatattatggtataatgaagtatctttgtcgacacgaatataaagataaaataagtatgaatataaaggttggtgataaggtgcgtttcctgaatacgacaggaggcggcattgtacgtagttttaaagggaaagatcaggtattggtggaagacgaagacggctttgaagttccggccctgatccgggaatgtgttgttgtcggcggcgataacgagatgcaggtgcatagctctaaccgtccgcgtgtgcagcctcagccccaggttcagcaaccgatgccgaaaccccagtccaaagaggaagaggtgaaggtggaagaaacagctgaaggcgaacgcctgaacatccatctggcttatttgccggttgaaccatcgaaagttatacaggatagcggctatgaagcttattttataaacgatagcaactactatctgttcttcaattatatgaaccgtcataacaatagctggataagccgttacaacggtctggttgaaccgaacacaaagatatttatagaagaattcggcaaagaagagttgaacgacctcgaacgcatatgtgtgcagctgatcgctttcaagaaagataaaccttactcgctgaagaattccatctcggttgaattgcatctcgatacggtcaagttctacaagcaacattgctttatggaaaatgatttctttgaagaagacgctatggtttattccatcgtacgtaacgacgttccggaaaaggaattgcttatctctgcagcagagttgaaagaggctatgtttcagaaagcccgtgaagatcgtcatgctccgcagccgatcgttaagaagaagtctgacggtgccatcctggaagtcgacctgcatatcactgaactgttggataatacaaacggactgagtaacgcggacatgctgacttatcagctggataagttccatgaaattctcggtaagtacgcaaaccataaagggcagaagattgtctttatccacggtaaaggcgacggagtacttcgtaaggctatcgaaaaagagttgaaaacgagatacaaacagcactattatcaggatgcttctttccgcgaatacggttttggtgccactatggtaacgatcaaataaggatttgctcctgattaataagaaataagtaccgtatgaatactgttttcctttgcagaaaatctgttgccgacgccctcgacagctttgccgacgtcgtcgacaatattgctgacgccctcgacaatgttgccgacgctgtcggcaacaactttcctgcaagggaaaactgaaacaggtgctgtcccaatacagctaacaaccggataaacgagaatgatatggctactgaaatagaaagaaagtttattgtaagaggagacttctcagccgatgtattcaattcgcaacgtattgtgcagggatatatctgtgcagtgcccggacgtacggtgcgtgtacggatccgtggggagaaaggttttctgactatcaaaggcccttcggacgaaaaagggctgagccgttacgagttcgaacaggaagtgccgcttgcggatgccgaacagttattgaagttatgcgaaccgggagccatcgataaagtgcgccaccttgtccgtgcagggaagcatatctgggaagtggatgtctttcacggagccaacgaaggtttggttatggccgaaatagaactggcttccgaagacgaagtatttgagaaaccggaatggataggggaagaggtaagcggtgacaggagatattacaactcgatgcttaccaaagaaccttataccggatgggcaaagaaataatactaatttaaacgataaaacactatgaagagaatcttattatcccttttggctgccgctctgtcattgccggccgtagccgacgaaggaatgtggttgcttcctttacttaaacaacagaaatttccggagatgcaggcactgggcctgaagttgcaggattacgacatttatagtcccgactctgcctcgctgaaagatgccgttgtcatcttcggtggcggttgtaccggtgagatcgtatcgccggacggtttgttattgaccaaccatcactgcggatacggtcagatacagcaacacagtacgctggagcacgactacctgaccgatggtttctgggcaaccactcgcgaccaggaacttcccaatccgggactgaccgtgaccttcattgacaaaatagaagatgtcaccgactacgtgaaagcggaactcgagaaagataccgatccgaacagtatgaactttctttctcccaaatacctgaacggactggctaaagcccgggtaggagaaaagttcctgcaggataaccccggaacggaagtggagatcaaagccttctacggcggtaacgtatattatatgttcacgaagaagatctattcggatatccgcctggtcggagctcccccttcttctatcggtaagttcggtgcggataccgacaactggatgtggccgcgtcatacgggcgacttctctgtcttccgtgtttatgccgatgccaatggtaacccggctgaatatgccgaaaccaatgttccccttcatccgaaacgctggtttaagatatctataaaaggagtggaggaagacgattacgccatgatgatgggatttccgggacgtacgaacaagtattatacttcctgggaagtagccgaacgtcgtgatatcgacaatgcagtccgtatcaatgtccgcaaccttcgtcaggaagtgatgctggacgagatgctcaaagatccgtctgtacgtattcagtacgccagcaaatatgccggatcgactaatgcttacaaaaatgctatcggtagcaattgggcgataaaaaaacgtaacttcgaacaggtaaagaaggaagagcaggatcgcctggttgcctggtcgctggataatgacgagtctgattacccggaagccttatcgacgatcgaacagatcgtttccgatcgcaaagaccttcgctttcgcaactggatgctggatgaagcaatcctgcgcggtattgaatttacaaaagtgccttcggatattcaagctatcagcgaagccctgaaaggtaaagaccgcagcgaacaacagaagcaggtgcgtatgttggaaatggcctaccatcgttttgccgataaggattacgcacccgaagtggacaagaagatagccaaagtgatgttgaaggaatatcgccggctggttccggctaagtcacaaccggcttactttgccctgatcgacaagaagttcaaaggtgatgtagaccgttttgtggattatctgttcgacaaatctatctatggaagtgaagaaaacttcgataaatttaaaacgcgcccgtccgttaaagcactggaagaagacccgatgatcctgtttgctaaatctgtgcaggaagaaaagtctaacctgaatgctgccctggcggattttgatgccggttatgccatcgctcaccggatgtatgtaaaagggctattggccatgtatcaggataaagccaatttccccgatgccaatttctccctgcgtctgacttacggccaggtgaagggatacagtccgcgggatgccgattattacagttgccagactacgcttgacggtgtgatggaaaaagaagactcgaccaactgggagtttgttgttcctgcccgcctgaaagaattgtatgccgcaaaagactttggccgttatggtatggcgaatggtaagatgcctgttgctttcagtgcgacgacgcatagtaccggaggaaactcgggtagccctgttttgaatgcaaacggagaactgatcggtattaacttcgaccgtaattgggaaggtgtaggaggcgatatacaatacctgccggattaccagcgcagtattatcgtagatatccgctacgtcctgttcctgatcgataaatatgccggtgccggctacctgttggaggaaatggatctggtggaataatcgaataatggaagttactaccataaaaaaagcgaatgatctttcgatcactcgctctttttatatctgatataattaaaatatgcctttttccaagtcagctgcctttacgcggaaaatatatccgttacgagagaagactaattctccgtcttctttctttttctggttaactaagcgttgaaaagctatattggcacctttaactatattctcttcaaattctcttacttcttgttcactcatgatgttcaagtttagtgtaaatatccgaattatatatctcttttttatcattcctgaatcctttggcaattacttccatcggagacatagaattgtctgttaccatccaataatcactaatggggatatatagttcaaaaagattgtgaatacccgcttcatatctacgacggatagtactctccggtatgttatgaccaccggctgccactctcatttttacccgttccactgccaaatccggcgtattcagccagaaatacaacaatgtaacataatatccttccctttgtgcttccctgatcaggtttgcgactgaccgggtggcaagcgtagtttccattgcaaaagtctcaccggctgcgatgagttctttaatgcgcttatacataattcggcttgcttctacagctacggcgatgctatctgcgttaaaaggggaaagccccttggctatctcgtcggagttcacaaactctttacacttcaacatctctggaagaattgtaaatgaagctgtggtcttccctgctccgttgcaacctgatattatatataaatatggcactatttgctgctttttgacagggcaaatatagataatagttttatatgttgtactatttatttctcaaaaatcgtgaaaatgtgcagaatttgtacgaataaccccctgtttcgttgtttcggaggcctgttttgttaattttagacccataaaaggtcgctcattatactatctgatatgaaaattccgttgcgggaaagcgttagggtttcgtctttttcgataagaagtccttgcttgaggtaaggggcggcctgcttttggcaatagattaatttgtcttttccgaactgtccttgaatttcggttaaattgacgccccacatagtacgaagcccggtaataatgaaatcgttataacgggtgcttatatccagctcttccacctctatctctggtgatccgctttcaatcccccggatataggccggaagggaagaaacattccattgacggctttccccattgtaggagtgagcggacggacctgctcccaggtatttcttcccggtccagtaggaactgttatgacgggagatcattccgggacgtgcgaagttcgatatttcgtaatgaagatagccgtttgccgttagccggtcgatcagagaggtgaacagagatacgctgacctcttcttcgacaggagatatctttccggcttcctttaatttatataaggcggttccttcttcatatattaaatggtaggctgagatatggggaatatccaggtggatagccctgtcgaggttcgactcccattctttcaatgtctgtccggggagaccgtagatcaggtcgatacttatattcgagaggtcattttctttacataactcaacggcccgcaaggcttgttcccggtcgtgccggcggttgaggaagcgcaggtcttccgccttgaaactttgtacccccatgctgatacggttgaaaggaaatgtacgaaggctggcaacgtactcgggtgtcatatcatccggattggcttcgagtgtgacctctttgcaaccggatatgtcgaataagcgttgtatggcatcaaatatgcgttcgaagtcagtggcttgtaattgggagggagttcctcctccgaagtagatcgtttccaacggttcattgccgatgtaatcctttcttatttccagttctcgaataagggcagtcacatacggttctttgtatttcatttccgtgttggaaaaaaaatcgcaatacaaacatcgtttggcacagaatggaacgtgtatataaagacctgccatatcgcactgatttagttatttcgataacaaatgtatataaaaaagctgcttatcaaaaactccggaatgttaacgttgcatagtccgaccggagaattaaagatttaccgtctgctttgattacgtcgaatactgtttccgtactgtccatgccaaaaggcaggagctgctccccggtagccattacattttcattgtagggaacattaaactcttttactgtaatcttttcggcctcctggtcgtagttgaaacggccgacgaaagtaccgtatttgttctcacttttatctctgatttccaccaactgtaattgtatggcataatatatccgttcgcacgggtgaatggttccgtccgccgtttcgaaatgtatcaactgccattgtccatctgcattgccgttcataggcgctttctcgcagccgcttgaaaagatcatgcagcaaagaagcatgataagtatatttaggttcttatttattcttgctttcatatgtcttatttcaggatgatcccttcttttttgattactaacatgccgccggtgttgttccccagataagtaccgtggtcgagtcccagtgcagcagagatagaccagccccggagtttccgtggactgtatgtgacttcatacagggagttgaattgtttgcgaacttcatccaaaggattatcgtatgtcccccaatgtctggtgtaactcatcagtacgcggtagcttatttctttcgagggatttccgttgaagccgatatgttgtgacaatatgcggttactcttaaacagtaaacttccgtcttcattataaagaggtgccggaaggagagggttccccattcccataccccagtgctgccagctttggtaatagtaattattgtaatagttgtctttcgcgctgatctggtattcgctgaagtggccggcaaacccgtcgtacaacatcggacctgtctggtctttggtggccaggccttcccatacgaacgtactgacccaccggttatgaggcaaggttacttccaggccgatatgtccgtccttccaccgtccgtattcaaagaacatctgtgaatggtcgtcgaagaaatgttcgtaatatcctctcagtacccagttgtccagatagtaactcaatgaaaggttccagctgcccacatggttaccctggatattgacctggtctccccagggcgaatcatcgcctccctttccgggtataaatacatcgaaaaactcctttatcccattcggcatggtgtagatttgtttgggatgccggttggcatcatattcgtagaccttgccgccgaactgtgctgccatgatcataccgaaatcgagttcgagaggaaatttctcttttttaccgatacggaataatagagacttactgtgatataatatatcttctacatattgcttgttgacagccacataatcacgttgccaacggtcgtcggtaaaacgtccgtaggctatgtgtcctttcactttcaaccaggcgttggtaaaaggcacatcggtgaattcctcaatgccgactcttacctggggaacggggcgggtattattcccttctaccattcctccgctgcttaattgcggatttttcccaaaaggattgcgttccttactgccgacactcatatttaggcattgccaggatatatcagcataagcctgctgaataataaatgcagaagtgttgtttgccgctgttgccagatcgagtccggcttgtaggttccagtgatgcttcagctttctattaaaggtaagtccggcttccagataggcactgttaggttcaatactggacagaccgttcctgttggcggtaaaccagagtggggcataattgcctctccccgcagtggctcctgtttctacatgataggtaagagacggatctgttgtttgtccatataagaatgtagtgtgacaacagatagtcagtaacactgttcgtaatttgtatatcattaaatacttgttatagatatttacttcagaatatagctattctgtttagtaaattcatgtacataaaataagtagagtgcgagcctccgcaataaaaacaagaggacaaagataggaaatattcaataatgactttcctgtaatccgctaaatttaattctagccttgtaaccagtttgccgtgttagtcaatcggatatgtggcatagtgggtaaggccggatctatgtaataagcatagtctgctgcataacatagttctcaaacaccgggcgataattgcatttttcctgtacattctctaatttgcggcctcgtgagtaattcacgtggttgatatttattgttaaactcaattaatacctgatatcatgaaagtataccaaacaaacgaaattaagaacatctctatcctgggaagttcgggctctgggaaaaccactctcgctgaagctatgctttacgagggtggagttataaaacgtcgcggtactgtagacgcaggaaatacggtgagcgattatttcccggttgagaaagagtatggttactcagtgttctcgaccgttttcagtgttgaatggcaagacaggaagttgaactttatcgattgtccgggttcggatgactttatcggtggagcagtttcagccctgaacgtaaccgatacggcactgatggtattgaatgcccagtatggtgtggaagtgggaacaatgaaccagttccggtatacagaacaatttcataaacccgttatttttgttgtaaaccagttggataacgacaaggcggacttcgatggtactattgcccagctgaaagatcagttcggtagcaagatcgtccagatccagtatccggtcagtaccggttcttcattcaatgctattgtcgacgttttgaagatgaagatgtatcgttggaagccggaaggtggcgtacctgatgtattggaaattcctgaagaggaaatggacaaagcgatggaacttcacaaggcccttgtggaggctgctgccgagaacgacgatatgctgatggaaaagttctttgaagaaggtactttgagcgaagacgatatgcgtgcaggtatccgtgccggtttggtcattcgcggtatgttccctgtcttctgtgtatgtgcaggacgcgatatgtgtgtgcgtcgtacgttggaattccttggaaatgtagttccttgtacagataagatgcctcgtccggtgacaaccgaaggtgtggaagttactcccgaatcgagtggaccgaccagcctgttcttttttaagacgactgtagaaccgcatatcggccaggtttcctattttaaagtgatatcaggaaaagtaaaagaaggagatgatttgctgaatgccgatcgtggatcgaaagaacgtatcgctcagttattctctgttgcaggtcagacccgtaatgctgtgactgaaatggttgccggtgatatcggtgcgaccgtgaaactgaaggatgtacgtcgcggtaatacattgaacggaaagggttgcgactacaagttcgactttatcaaatatccggatcctaaatatcgtcgtgccgtgaaaccggttaacgaagccgattcggaaaagatgatggagatcctgaaccgtatgcgtgaggaagacccgacatgggtgatcgaacaatccaaggagttgaaacaaacgattgtttccggacagggagaattccacctgcgcacattgaagtggagaattgaaaataatgataagttgccgatcgaatatatcgaaccgaagattccgtatcgtgaaacaatcacgaaggcggcccgtgcggactatcgtcataagaaacagtccggtggtgctggccagttcggtgaagttcacctgatcgtggaaccgtattacgaaggtatgccggctccggatatgtatcgtttcggcggacaggaatttaaaattagcgtacgtgatacgcaaactattgatttggactggggtggtaagctggtatttattaacagtatcgttggtggagccatcgatgcacgtttcttgccggctattctgaaaggtattatggcacgtatggaacagggaccgttgaccggttcgtacgcccgtgacgtgcgcatcattgtttatgatggcaagatgcacccggtagacagtaatgaaatttctttcatgctggccggtcgtaatgccttcagtgctgcctttaaagaagcaggacctaagatcctggaaccggtttatgacgtagaagtatccgttccgggtgattatctgggtgatgtaatgagtgacctgcaaggtcgtcgtgccatcattatgggtatgaacagtgaaaagggatttgaaaagttgttggccaaagttcctttgaaggaaatggcaagctattcaacttctttgagttctattactggtggccgtgcttcatttacaatgaagtttgccgcttacgaacttgttccttccgatgtacaggataaactgttgaaggcttacgaagctactcaggcggaagaataatcaaaaaagaatctctaaccataaggcagcccttgtttcaagcggctgccttttttcttcctaaagctccctcttcaactgctccaacacctcaaaaacacccggacaagtttgcgcattcttaatcgtcagtgcatgtatctgataaaacttcttcctgtccgtatgcggatactcgcggcaagctttcggcctgtcctcataaatactgcaatagttatccgcccccagaaacgggcagggcatcgaccggaacacatagtccttatcttcgtctatatgcaaatggcgtgttactacttcatgtggtttgatgcggagcgcctgtgcaatccgttcgatgtcgcgatctgtgatacgcggtcccagcgtacggcagcaattcccgcattccaggcaatcgatcgagtcgaatacctcttcgtggatggcatgaaccgtatcgtccagtacccgcaaacgattcttcttaattgatttgaaaaaggcttttgtctctttttctactttcttagctctctccgggagggagttaatatccataaaacgattgggttttaatttgagggaacaaatgtaatcatttgcaacggaaaaagaaaaagcatcttcacacggttgttgcatccctgtaatagtaaaccgcttcttttgtacagtgtaaatctcttacgtatgaaattaagaaaatattatccgaccgttgtgctttctgacattcatttgggttccgagcactcaaagacaaaagaagtaaccaatttccttaaatatatcgactgcgactgcctgatactgaacggcgacatcatcgatggttggcaactccagaagtcaggcaaacgatggaagcaggcacagaccgacttcttcaaagtcctgatgaagatgatggaaaagaaaggaacaaagatcatttatgtacgtggtaatcacgatgatttcctggataaactggtcccgttccagttttccaatatctctatcgtcaaagattatctgctgaacagtcacgggaagcgttacttggtgactcacggtgatgtcttcgatacagtgaccacccacatgcgctggcttgccatgctgggcgacataggatataccttcctgttatggctgaataaaatctataacaagaaccgggaaaaacagggtaaaccttatttctccctttcccaacatgtgaagcatcgggtaaaaagtgccgtctcttacatctccgacttcgaaaaggaactggtgaagctggctttatccagaaaactggacggtattatctgcggacatatccatcaggcggccaatgtccggtatgacaatgtgcactatctcaattccggcgactgggtggagagtatgactgccctggttgaaaacgagcaaggcgaatggagcattctcacttataacaaggctgaatatgaggccgatgaggaaaagatttcgaaaactgtattatacgcagaagtgatatgaagatactgtttgtcatacaaggagagggaaggggccacctgacccaagccttatctcttcgccagaagttgaccgacgaaggtcatcaggtagttggcgtacttgtcgggaaaagtccggtccgccgtatcccgtcgttttttacagagaagatcaatgtgccggtctatcacttcgaaagtccgaactttctgcctacggctaagaacaagcaggtgaacctattgagtagtatcggttataatctgctgcgtttacataaatatgccggtagcatccgttacatcgaccggatgatccgggagacggaagccgatgtggtggtcaacttttacgaattactgacgggactcgcttatctgtttacccgtccgaaagccgttatgatttgtgtcgctcaccaatatcttttcctccatcccgacttctcttttccgaagttgaatagcgtttctttatccctgttgaaattctttacccgtgtgacggctatcggtgcgacgaagaagctggctttgtctttcagaaaaatgcgtgaagtgcccaatgataagatcgttgtagttcctccattgttgcgtaaggagataataaataaaacctcgcgtaagggcaactacctgcatggctatttattgaacagcggtttcagtgaagaagtaaaagcttggcacgccaggcatccagacgttccgatgcatattttctgggataagaaagatgcaggagaaacaacccggatagacgataccctttccttccatcaactcagcgacatccgcttcgttaaatatatggcaggagcgaaagcttatgcgacgactgccggtttcgagtctgtttgtgaagcaatgtatctgaataaacccgttctgatggttcctactcatatcgaacaggcttgtaatgcctatgatgcctctttgtcgggagccggggtagttgccggccgtttcgatttggatgctttattacatctgtccgaaactcaccagccgaacccgtcttttcgtcattgggtgaaacaggcggattggttgatcctgcgtgagttccgagaagatttgttgatggaggagatgccttcttccgtatggcatcgtttctcgatgcactgggtgtataggctggcgaagaacttctcgttgtagcacaccggatagttcccgacagataagccttttactcaggatatctaacattgtagctcaggagtattaagctcttaatatccttctttcaactatgtaatgtatgcttttcaaaaaagtaatgcctgccttgcataaaagtaaggcaagccttacgtatctgtaagctaggcctttcttattttaaataagggagtctgatgattaatcatggtatgccggaagtttagctcccggtagctgatcgcttaatggtaggcagctgccgacggggatcgtgtcatgcaatatacaccagaattcatgttgtgtcaagcatttgcgattaaaaatgtatgaatgaatccggattatatatataaagtacgcgtacattaatatatgcatattcttttgacattattatcgacagtcttctgtccttttatattatcaaaataactttcccctctctgggagggggtaggggatgtgtgaatttcttctttgtaaccctaactccccctttcgtacagagtactgtattcaattgataagaaaggatatgatgatgtaaaaaaatcaatgaaaataattgcggataaaaaactattgcttacttttgctgatgtatttgacgatcgtacaagcaagccgatagaagatagatcggcattattatagaatagaacttagaattacttagtattaatattaaatttttgattatgaacaaaaagttttctacttttttggcaggtgctgcgcttttgagtgcaatgtctgtttctgctgctcctggtgatgcagttcagtcattgatcttaggtcaaaatgctggcttatatcaattggctgcagaaaatggtaaagtgctttctatggacaatgaaggtaatttaactgttgtaactgctcctactaattctactggtttagcgaacactctgtggtgtgttgaggttgcaacacaagttcaaggtcaggctcctaagtttgattttgtcaataaaggaacagaacgtcgtttggatataactatggctggtttggaaggattggtaaaatatactgcttctgatgctccagttcaagttggtggagaaatttctggttgggcattttctaaaacttatgaaaatatagtagaagaagaaaagccgcttttttcctattttaagactgactctgttattggatttgttttgactggggatgatgttgctgttgctaaatgtggagcgaatgaagatggtgtaactgttgctaattttgagaagtttactttgaagacatctgatctcgttactctaaatgcaaatgaattgaatacaattttaggtgttcaagatgcagataagggtgttaagctaactttcaagccggatacattgggtactactttggaaaacccgttcagctcacaaaaatttgttgcagaagaatctggtgatgctggttatctgaatgtaaagagaggtgatacttatttaagagtagatactacttttacaaatgataagggtgctcgcttccttgcttataaatggacttcagctgatgacaagactgcttcaactattggtgaacagtataagtttaagtttacttacagcccttcaaatgatagtttgactattcaggttaaacaagctacatttgataatggtcgtgttcttgaagcatttgtttcattacaggatttgatcaaggatgaagctcgtatcttaacagttgatacattggctcagaatacaatgatctctttaggttataaaggttgtaatgctgtttcaaacagaacatctattgcttctgacttatatgtaattaaaaatgctgataataaatatttagcagttcctttgtatggtgatagcactgctcaatgggttactcttgacaaaaatatggatccttggcatatgcctgcattccaatgggttgtagagaaaactcgtacagcggcagaaatggaagctacttcccctatcaaaattacaaaccgtgaatttggtgtagttgttaatgcttctctgcaattgtatactgatggtacatcttcagtggttggatctgatatttctgcatctaactttattgctgaccctgcaaatgttaaagctaatccttatgtgggttatagatatctggatttcgactcattgactgtaactacttataaattgaaatatctacatgaatttgcagacgataaatacatgggtacttcaagtgatgctactgattctgtattatatgtaggtgctaagtcttctttcgaattagcaggtatggatacattaggtgtaaactatggttatactacaaacgctattgcttcaatgaaacagcttgttagaaaagcttatacattgaaactgaaatctacagataaatatgttatggctgatgcagaaaagagatatgctgtatctgctacaggaaaaccagctgtgttctatctgaaagaaaacaatgataaggcaaatactcactatttcgctttaattgatacagcttcttacgcagatgttcgtaaggtcggtgttgatgataacaacgtttacttgaaagttcagaatttgaaagaaactcgtacttctgcgttctcggtagaaatagatgatgctcctctttaccgtcgtttcaacaatgctgtattaaatgaaagcgctgttgatgctgctgatagcttaagattctttgaaaatattcgtcatgaatatttgatggatgaaactaataaagaactgcagaatgatggtgttaattacttaggtatctggacaaaagataaagctaaagccggtttgtcattccgtattgatacagcttgggttacacgtggtcttggctttgttaaacctcagtatttgatttctgtatctcgtcaggatcaggctgctattgctggtactccttgtacagaaaattctcatcacgtagatgctgaaggaaatccgacagatgctgaacattgtgttcacgctacacctggaagagatggtttcaactatggtaaatatctggtaagctttgctgactctgtaacatatgttggaaaggataaaccttatactgatgttaaggatggttatactcgcgtaggttttgtaaaggcaattcaaactggcgatagcttgatcgtattggttaatggttatgaaaacatggatccgaaagatctgaatgtagaagaaattattaaagcatatactaaagctggtattaatggtaagtatatcaatgacttgagaggtgataatcacaaaaactatacttggtcattccgttatacaaatccggacgttgcagtaggtgtaagtgaagaaggtgctgaaaactcattcttgatcgaatctatggcttatgcagaaggaactcctgctacaaagaaagctattgctcctgaaaaagcagcatggatcaagatgcagaatggttgtattgtattaacagatgaaaaatctgaattcaataatgctaagactggtggtgacggtgctttggttttcaatgtagaaaacattgaaaacgatgaaatggctacagatactaaggatatcacaactaacactgttagcgtaattgctggtaacggtacagttattatcaagggtgctgctaacaagactgttactatctctaacgttcttggtcagacaatcgctaacacagttctttcttctgacgatgctacaatctctgctcctgctggtgtagttgtagtagctgttgaaggcgaagctgctgttaaagcaatcgttaaataagaaataaataataattaaatgaatgcttctctactcttcccttcggggaagggtgagtagcctgtgaaggtgaacagattggaagcgcaattttagtaataaaaataaaataaagttcatccatgagtaccactgtgaagtgaggaaatggacaaaaaacaaccccgtcgatatttattatcgatggggttttgtttttaaagagctccaggaaacagagtctattatgttaaatagaaaaaccgtattatatagaagacgattcctgacggaaagcatctttcacataatacggttatcttctatgaactaataatttttactgcttcaaagcctgttcaatatcagcaatgatatcgtccgcacattcgataccgacagagaaacggatcagatccggagcaataccggcttccttcaactgttcgtccgtcaattgacggtgagtatgacttgccgggtgaagcacacaagtacgggcgtctgctacgtgagtaacaatagctgccagcttcaggctatccataaacttgatagaaacatcacgtccacccttcagaccgaatgacaacacgccacatgaaccgttcgggagatatttctttgtcaggtcataatacttattcccttccagatccggatagttcacccaagcaaccttatcgcagttctgcaaccatttagcaacagctaatgcatttttacaatgctgtggcatacgtaaatgcaatgtttccagacccaaattcaacaggaatgcattctgcggagactggatagaacccaggtcacgcatcagctggctggttgctttcgtgatataagccattttgccgaatgtctttgtataagtcagtccgtgataagattcgtccggctggcaaagacccggatatttgtcggcatgtgcttcccagtcgaagttaccgctgtcgacgatacagccaccgactgcagtagcgtgtccgtccatgtatttggtggtagaatgtgttacgatatctgcaccccattcgaacggacggcagttgatcggtgtggcaaatgtgttgtcgacaatcaaaggtacaccatgcttgtgggcgatgtgggcaaacttttcgatgtccaataccattactcccggattggagatcgtttcgccgaacaataactttgtattcgggcggaaagccttactgatctcttcttcgctggcatcctgatcgatgaaagtacattcgatacccagctttttcagtgtaacggacaacaagttgtatgtacctccatagataccggttgcacttacaatatgatcgccggcttcgcaaatattgaaacaggcaaagaagttagcagcttgtcccgatgaagtcaacatggctgcaacgccaccttccaacgcagcaattttggatgctacggcatcgtttgtcggattctgcagacgagtataaaaataaccactctcttccaagtcgaacaatttagccatctgttcgctggtttcatacttgaatgtagtactctgatagatagggagcacacgcggttctccctttttcggttgccagccaccttgcacacacaaagttgccggcttgaatgaattgctcatattttttatgtttgctatgtaattatattctgcagacaaaagtaaagaatagttcgttctatttacacaaatctttgatcaattataaaaaatacactattgtttcaaaataatcgtgtacctttgtacccgattttggtgtcacgcttccaattccacggaaaagtgatgaaaagggaatcaggtgtaaatcctgaacagacccgctgctgtaagctccgccaaagtctttgagcacgactcaatccactgttcgcaatgaatgggaaggacgctcaaagatggagtaagtcagaagacctgccaagataagaagtttaaagctttcgggagataaggctaaaaacatatgagaaagaacattcatctactttaccggaggttctgcctgttcatgtgttctattgtttctttcatcgaaagcatgtaaaaaacaattaatgaatttggtgaaatgagaggtttcatacatgtatttcttttattgagttgtttgtttccagtaagtctggcggcacagaataaagtgattctatccggcgaagtgaaagagaaggatgggacaccgcttccgttggctactgtcgctatagaaaatacgatttcgggaacgtatacagacgaccggggacgttattcactgtcggtaatccccggcaaacgcactcttataattaccctgttaggttacaacaccataaagaccgttgtcgatatccgtaaaaatatgacaatgaatttcacgatggaagaaaactccataaccctgaattcggttgaagtatacggtaaaacgaaaacccaacaggtgaaagaaagtgcttttgcagtcaatgcgttggatgttaaaccacagatcaacactctgaagaatctgaatgatatggtgaaccgtacaaccggtattaagattcgggaagagggtggagtcggttcagacttcgacttgtctatcaatggattatcaggaaattccgttcgttactttattgatgggatgcctctggatacaaaaggaagcggtgtctcgctggcaaatcttcctgtcaatatcattgacagggtggaaatatataaaggggtagttcctgccagcttgggagcagatgctttggggggggctatcaatattattaccagtcaggaaaaaaagaattacctggatgtttcttatggtacaggttctttccatacgcatagaactgacctgaatgcccaattcgtagaaccgaagaccggattgatcatcaagccgactatcggagtcaattattcgaagaacgattataagatgaaaggcgttgaggtatgggatgaagatagccgtaaatatattgaagtcaaccgtaaacggttccatgacgattatttttccttgttgggccaattggaagccggctttgtcgataaagcgtgggcagatgctttctttgtttccgggtcttattccaaaatagataaagaaatacagacagggtctatccagacaaaggtgatcggtaatgcggagcgtcattccgatgcatggaatgtatcagcccgttatcaaaagcggtttgagaaaattaatacaaatgcatcgctttcccatacctgggacgcatcgcttactgtcgatacggcttatcgtatctatgattggaacggagattttactccttcatcccgtaatgagcttaatggccgtgggcgttccatacgtcattacaaccgccctatgactatttttcgaggaggcgtcgattatgcgatcaaccggcatcattcagtcagtttgaactatctgcttaaccgtaccggaaataaacgtcgtgatgatgtcgacgaaacttttgagccaaccaatgatgtgctgaccaagcatattctcggattgacttataatcagtcttttttcgacggaagatgggagagtaccgtttttattaaagattatatcaatgccacctctatcgaacaaaacgatcttgcctggataaccggctcggaaaatctcaaaggacatttttcgaagagttattggggaggtggtttggggctgcgctataccatttgggatgtactggcgggaaaggtttcttatgaacatagtgtgcgccttcctttgtcgcgtgaactgcttggaaacggaacgactatctatccgaatctcgcccttcatcccgaaagcagtgataatataaacctgggtctttttggtaactggtatccttcttacggtcattccttctattatgaggttaacggatttcttcggtttgtcgacgattatattcaggcaaccgtatcggaaaaagaaggtatgatgcaatacgagaatattccggctgtacatgtgaaaggtattgaaggggagatgcgctacaattggaaaaatagctttcagataatggtcaactgtagttataatgaagcacgtgaccaaaagaaatataaaaccgacggtaagccttcggctacttataataaccgtgtacctaaccgtccctgggtgtatagcaatgctgatgtaagctatacatttcatgatctggcacagaaggaagatgatcttcgcatcggatattcctggcaatggatacactggttttacttatcgtgggaagcatacggagcccttgaaagtaagtcgcgtataccgactcagaatgtatcgaatcttaatgtgagctattcatggatgaaaagacgctataatgtgtcattggaatgtagtaacctgtttgacgctacggtttatgacaattataaactccagaagcccggtcgtgcattcttcgctaaattcagattattcattaattaataatttaaagattatcaaatgaaaaagtttcaattactattttgggcattattaacggcattgcttaccttgtcttttagtgcttgttccgacgacgatgagcctactcccggaccggagcctgctccagaagcacaaacctatcacttcgacatctggattgctctggataaacacggtggtatgggacgtgacgtacaaactcttgtcaagagcatcgactctctgaaggctggttcggaaaagatcagttttgaaggagatggaacagaagttcatagtgttatgtctttggaaagtattatcaaagggaaatactactatcaggttcctgtatcgggggatcgtttttccaagtatacgctgtcgaataataagatcaatgttattcaagagcagaaattcggcacaaatacgtacgatacccgtaagtatacacatgcctggatcgatgataatacgcttgtgatcatggcttctaacggggatggagataaaattatctggacgaaactgaatgcgaccgatatgagtattatcaaggaaggcgttcttgatattcctcttcctgaaggagataaattattctctacttcaggtattctgaactatcgtaaaagcgataataaacttatttatttctatttggggaagaaaagtaaacgtggagatacaacacctttcttctttacaactgtaatcaatgctgaaacaatggccgttgaaagtaatatacgtaatacgatggctcatcagatggttggtagtgcttatggtgaattgttacagaaatgtacgctggttgacgagagtggaaatctttatcttgcaggtttctccgaaaatgaagatggaacggagaagagccatctgattcgtatcaaagccggtgagaaagattttgatcctagttacgatgctttcactaatacaggaaaacttgtttctctcgaatatctgggtgatggtaaagttcttgcatatgcacgtcaggatgaactaggtatggaaattgatagttacagccattattatacgatcatcgacctcaatagtaaaaccagcagccgtgtaaaatacaatggacaggatctcccgtacagcggtggccgcttctctcagcgtactgcagtggttgatggtaaggcttatatcggtgttaatccggaaagttcaaatccttgtgtctacatttatgatataaagacaggcaatatagagaagggtgctgatattaaagaaggctactacttcgagcagatacgtgtacttgataacgaagatgctgaataagaacctttcaggttccagtcgaaatgtaaattgaagtgcactcctttggttgagtccaacttttgggggcacttcagtttgacttataatcttccggaggttttgctcattatcaataccggtttccctaacggaggatatgacttttgagattttgtttttgtctcagtccagggagctacattatcagactgcataaagtcttcaaacgtatatggttctcctgcaagcctcctgattctgtcaacaatcgcccagcggctgggagcattgtaatatggaatgttaatatccatacagctgaccttttcaggacgccaaattcctgattgataaagaaaagcaccttcataagctcctacataagtatacttttcttttcctataaaatcactccagggaacccgggataaatcatttgtcaaagagatattccgataacaaccgaatttttgccaaaggaacacttcggcctttacatcttctgaagcttcacctccataaatatattcatctgctaaaagtccgaaagcgtgtcctcccgcttcgtgatgcactaatccttcaaaatcataaggaggtgcctctttactgattggacaggctgcaatacaaaatccgcttgaatagagacgggctgttccggcatatttactgctgttcaggaagaggatcgtggtcatttctacgacatctcttaattccgggatcaaatttagataaacttcgcaaatgctatcgctccaatcaatattagtgccttctccatatatcgatccgaagcggttattgatcgtaatacccggtatctctccgtttacgccggcttcttccgattgagcaaagatcatataaacattaaaatattttcggtttgatttatagggttctatgttgaaaaaatgttccatcgtttggtttgccaaattctcatatcgtccgtctttcaacaagtctgctttggtgaatccatctcccataattgctacatttacgcctttaccggctgatgccgtctgcaaacgtacatattcaccatctgcgtaataggtcagtccgtcttcttgttgtatgacacggactgttgttgttagaacggaggatcttatgttgatttttgcttcacgtcctacctttgtatcattagcagagactgaaacaaacagcagttttgagtcttcgcttttttttacttgacaccaggacgctacttccggttcaatggtatacgtatattcaggattataatcgtggtcggtatgtgttgaattgactgctattattccactgccaccctcggaggtgaaatcaagttgttcggtggacaccgtaaattgaagagcctcctgtaaaactaaaatcgtatcggcagcagagatatttgttgctttgatatagatagctcctttacgcatttcaggctccgggttctcgctgatcgttaaatataatgtatctgtcgttacggcttttgtttcagagatttggagccaattccgggcttccggagatatgctgactgtatagtctacattccggtctatcggaaatggccatttacctccgggttgtcctatgtaccattccctatcggtcgcaacaagtgtcgttttttccttttgagtgacctttaaactctgagcaaccttgcctgcacgaaaccgaatttcggctgtacgttctttatctgtatcattttcagcgaacataatacgtaccgaggaggtatttacatcccccgatattgtacttaaggttacccacgaagaattccctgtcggaattacctctgcaaaccataccgaatttgtattgatctcaatagattgttcttctcctttagccggtatgttcaattctgaaacagagattgtcagatattcttcttcatctttgcaacctgctagaaatagtaatgaccagaaaatgaaaaagaaaatatttgtgcaataataagatttgcagatattcatattgatggtgttttcaattatttacaaaggtacactattttcctgattgtacaagaatggtatataattcaaccttaccctttagggctgtctaagacattgtaaacacaaacttattttaatatttttttctgcaatgcccggaaccagataaacgaaacaacccctttcaacatactcgatatactgatcgcccaccatacaccgataatccctaatcccattgcagacaaaacgatcgccatcgggatacgcagcgagttgaaagtaatgctgatgatcgcaggcggaaccgtacgtcctgtcccgtagaacagaccttgcatagtgatctcaagcatcatgaacagcattgaatatccgtctatccgcaggaaaatacctccggcctcaaatgcttccttctggggaacgatcagtgagaagacttcgctaccataaaagacgaataataaagtgcacagagtaccgaatatggccgtcatttttaacgtcgtgtgataggcctccaataccctattcttttcggaggccgcatagttctgggcaacgaaggcgcttaatgccgtactgaatccctgggaggtgttccaggcaatcgcttcaatctgccctccggccgtaagcgtcatcaagccgatatgccctccgtaagtggaggcagtccgtgccataaaaatattgataatggcaaatagtgtattcagcatggcaaccggtaatcccagttgcagtatccttcgtgaatagtttttctttagtttgacgaagaatgagaatcctcccaataacctgcttttccattttagttgatatacgaatatggcgcatactgttgcttgcgacagccaggttgcccaggctgctccggctgttcccatgtcgaatacaaaaataaataccgggtcgagtatcatattaatgataagtcctgttccgctgatgtaaaacggtattttacttagccctgctgcattgtggatgccggtgaaggctgccgacaggaatataaaagggaaggctgtcgatacgatccgtaaatactccacggcattagcagcaataggtgcttccagtttatagactccgatgataggggttgcaaagacgaacaataataatccccaacagacggaaatgatcagggcgatggtaagattatgggaagaataatttcttgcatcttcttcgttgcgtgcaccgatgctttgtccgacgcttacttccgaacctactttgttcaataaggagatcgagttggtcatccaggtcaggataccgacggccccgatggcggcaacagcctcgcttcccaagcgcccaacccaggccatatcggtaatgctataagccatctgaataaaagaagttcccatgatcggtaatgccagattgaataattggcgtttgatgggaccttgtgtcaggttctttgttccttgcatgttcatctaatttgctgcaaaagtaggaataatcgtgcagtttatattactttaaactagtttgtggctttagattgattaatatttgtaatgattcttgcgctatagaagcaatttttgtgttgtttctaatagagaaagccgtactataatttgcttatagtacggctttcttattgagtgggggatttagaaattaatattaactccaatcatagcactgaacttctgtaacgggtaaccgctgtaaagttcgtatttctggaataatacattgttcaacttcagatacagaccgaaagtatcgttaaagttgtatgctccggtcaggtccagttcgttgatatttttcatcttgttatcattgatatgatccatcgttgttttacgtcctgtggccagatagtaatccaatgatgctgacaaatttttgatcggtctgacagttacaccggctgtgatctccatttcaggcataccgtatgcttccggctctttcaggttcataaaaccatttctccgatctttagagtattcaacgttccagttattgtaaactccttttaaagatatttcaaataattgctggtaactgtatttcaggttggctccgacaaataattgtttggagtccacaaggtttaacgggtcactaaagtttccgaaatgatcttttgtattgtttaggcttgggataaagaaataatcatcacttgtaattctatatcctccgaaaatatcaaaccagaaacctggagctaccccgctcttaatccccagtattccatctaaccagttgcgtgaaggagttattctggatataggagaagtataacggtttacctggaacaagtcatacatgctatttgattttaacttaccattagcattcaggtacaatacagtcttgtctgccacttcaacgtctgctgagatattgggtgatgccatgaattctttatgttctccgctgaagaacattgcgtttactcctagtttgacatgccagttatcgccttctaccttataataaggacttaatgtggcagcagcaaaattgtcgaagtaatatgcgtacccggctttttctccatccggtatcttcatttcatttggtaagctatagttgaagtattggaagtttccatctaatcccactctttggttgcctccaaaacctgcatttaatccaaaattaagattgaatgttccttctgtcggtccatctaaaggtttgccagtagcatatttataggagaaattggtataacctaaatctaacagataaccgacaggcgcgtcttcttttgattcaacacctacattagctttgaccgtttgggctacctggttggtttccacatcgcttactaagtcgggagctacactcgaggccggatctaaatcaactgggatcccgtaataattaaatccggaataaccatatttaatacccatcttcaatgccagcttatcgaagttgtgcttgaagttaaggcctcccatattatcgttcagtttggctttcaccttttcatctatctgaagatatttcaccttcccattcgtggagcggtgggagaaccagatattcagctgatctttgtcggtgctgaggatgtgatatcccaggtcgccattcagattaagataagttccggcaccgaagttgaaataaccacggcgtttgttgtactggatatccgtcatgatgttgcctgaaggaagcagactgatctctttcgccgggtcggctggcaccgtaaagttggcatagtctatcggcatcttctttaccaccggttctttgatgaccggcagggtgttgactttacttgcgtcctgtaccgaaggatcatattcgcgttcgagcgtcatttcccggtccagattctgtttcttcgaagtatcttcctgtgcattgactgtggctgctgttcccaacagagcaacgacacacagtgtttttacattatatatagtcttcattgtattcaattattgctttagtttacctaatctatcttctatcatgccggcaatttcgtcgtcacctttatagttattcttcaggttgttcaaataagcacgagcctgaaggtcgtctccctggcggatataaatatcagcccacaggataaagccacgtgccaaccagtactggtgaggtgtaccgttcttggcaaaatcttccagaaccttttcggcattcttatcgtctttggtatcgtagaagtattgagccaacagatatttggcttcggctccgtgaaccgtacgggtatctttactaagaaccttcaggtcttccagcgctttcgccggctgcttatggtcgatataagccttagcgcggatatagcgggcttcggcttctacctcaggagacagtttcggatctttcagcaattcgttggcagcgagttgtgcttcttcctgttgtccggtctgtaaagcgcaacgcatgatacccaagcgggctgcttgtttgttttccggattttctgcgattacctgtaagcgtttgaaggtttccagtgccgaagcgaaatcctgggtgagatattgcatttctgctgtacgtgccaccgactcttcaaggaatttagtatcgccgttatcgataaccgatttgaagcgttgcagggcttcatcatattctttctttgtaaaagcaatgcttcccaggtaataattggcattcgaactgaatgctccttccgggaatgtctgcagataattgatcaggctgcgacgtgcttcttcgttattaccccggttgaatagtttctcggcagcaatataagtcagtgaatcctgttctcccacttccagacgaacgttgccgcctatcgaatttacatagttggcataagcattgatatcgttcaagtcgatgtaaacagactttaagtcttgcagagctactcttgcttcttcgcttcccggatagttgctgatcacctttttataggcttcggctgctttctccggctggttgtcgttgaagtaaagcagacctagctggatgccggctttacgtgccaggctgctttgcgggaatcgctgaactaatgactcgaaagcctgggcggcctgcgaactgttatccagtaatacataggaacgtcctttttcgaaaagggcatcgtctacatattgtgattcaggatagtcgcggatcaggcggtccatcatattgatcttccctttataatctttctgcaatcccaacaggaatcctttctggtaaactgaatagtctccggcagaaggttgtagttgtgcagcgcgagaatagttttcttcggcttgtgcaaactggcggttctgatactgacagtcgccgatacggttgtaggcatctgccaaggccggagcattttggttaccttcaaggtcgacatactggcggaagcgattttgtgcctctccgtattctttcagtttaaagtagcagtatcccagattataatgagccagtgcgtacatgtcagtattgcgttggcgggtattgttcaggtaggtgcggtaatcggaaatcgctttctggtattctccgagtcggtaataagactctccacgccagaagtaagcatcgttacgtgactccatgttataagagcccagattgatagcctggccgaacaggtcgaccgcttcatccagcttcatattggtaaatgcctgtgtaccgagctggaacaggatatcctgtttagcttccaatatctttgtactcggacggttgatcttgttgatcgaactgagggcggcctgatagttctttgttgtcagatagacttccaccagataatcgttaaccttatcggcatattgggaattagggaagtcattcaggaaatcttcgaagatggtaaccgactcgccgaatccggtaaaggccgtttcgtggatcaggagagcgtagttaaacatggccgtttcctttatttgtttgtcgaacgaagaggttgctgccgcttcgaatgccatgcgggcattgttcttgtcgttcagcttcagatagctttgtccgagatagaggtaagcattctgtgaaagtgcgtcgtcttcacgaacggtctgcgacagggcattgacagcactgttatagttacctttattataatagcaaactccgaggatatacaggtcacctcttagcggactgtcggtagacgatacgtatttgcttagcatattgatcgccttgtcctgattacccaggtgataataggaattacctaagacacggtatatttcgctattatttttactgttagggtaggaggataggagttcttctccttcgctgataaccttttcgtatttattttgtataaaatagatctgtgtgatgtaatataacgattgttcgcggtagtccggcatctctttcaaacgactgaattctactagtgcgttattatatttgccggtagcgtaatcgatataggctacataataagtagctgcttcacgatactgtgttccgatctgttggatacgtgcaaaatatccgcgtgccttatccatttctcctgtttgtaacagagagtaggccagacggaagctgtaagtctcctgttgttccggactaagcatgtcgatattcgactcgttgaaccagaaaatagctttctgatattcgccacgtccgaaatgaaccgaaccgatcaggaagtttacctcatcactgtggcgtgaagccggatagttttccaggtaatctttcaatagttggtcggcattgggtcgtccttgctcataagccgcatatacgatcatatagttggcttcctggatcagatcggcatctttcgagtgctgtttgtaagcttccagcttatcgatacaacccggataattctttaaactaaacaattctttaccttctatgaacaaacggtccggtgcctcaaactggtacgaccgttgcccgctagccacatgacttcctaccaccaggcacagtggaataagtattcttttcatcactccttcgctttaatgtacagatattaaacagtctctgttagttctaagttgcaaatataaagaataacatacaaatgctaagtaagttattaacaaaaagaattaatatttggaatcataaacaaacgtgtcaaaacaaaaagtgatggtatcggtcatggtttcgtttaaaaatgtcttatatttacactctcttcatacagcaaaagatgggtggatcggaagacataaaagaattaagcaggttgttggaaagctataaaggccgttttatcagctttgcaaattcctatgtgcaggaattttccgtagcggaagatttcacgatggaggcttttatggattattgggaaatgcgggaaatgctgcagcctgattcgaatgtgccggcctatatcctgactttgattaagcacaaatgtctgaatcacttgaaaagaagacaattgcaggaagatgtctctcaaaggttacgagcggttgccgaatgggagctgaatctgcaaatatcctctttggaagtctgcgaacccacagagcttttcactacagaaataaaagagatagtaaaccgaacccttcagcaattacccgaacagacacggcgtgttttcctgatgagccgttttgagaataaaacccgtaaagagattgccgacgaattgaatatgacttcgaaaggcgtagaataccatatagccaaagctctggctgcccttcgtgtgaatttgaaagactattatacgatccttccctttttattttataatctgaaatttttaacttttttaaactaggcgcttgcttctcccgatttctatatatacagaagatagaaatatggagaaagaattactatataagttttttgcaggaactgctacactggaagaaaaagagtgcattatgcgttggatacaagtatctccggataataaagcaacttttctgaaagaaaggaaattgtataatgcgatgctgttgaatgctgaaccggagaatacatcggttgccgggaacaaaaaacaacattggttgcattcaggtttcatgaaattcctgcggatagcggcaatgatcgtcatcgctttcggattagggtatttcgctcaggacagagacgacaagggacaggtagctatgcagactatagccgttcctgccggccaatgcgtcaatatcacgttgcctgacggcagtaacatctggctgaatgcgcagacaactatacaatatccggtttcgttcaacaaacatgaacgtaagatcaagctggatggcgaagcttactttgaagtggcgaaagataagaaacggccttttatcgtcaatacaaaagaatgtagtgtggaggtcttgggaacgaaattcaatgtggatgcctattccagccgggataaatttgaaacggtgctgatggaaggaagcgtcaaggtatccatgcataatagtccttcggaaacaatttcactaaaacccaataataaggtgtatcgttcgaatggtaaactgttgacacagaaaattgataattatgaaagataccgctggaaagaagggttgatctgcttccaggatgaaccgttcagactggtgatggaagactttgagaaattctatggggtgaagataattgtgaacaaccagaaagtgacaaagtatttgtacacagggaaatttaagcaaacagatggtattgactatgcgcttagcctgctgcaaaaaaatatccactttgcctatcagcgtgaccgcgaaaatcatgtggtgtatattaattaaataaaataataacctttttaaatctgactgcctatggtatagtaaaaaatgtttttgttaacgaaaaagccggttgatggtgacgcatcaaccggcaggaatctcaatcacaattaattaaattgtattattttgaaacacacaaatgtatgaaaaaaaatactttacagggacattattgcctaaaaagtcccaaccttaaacaactctttagaattatgcgaataactacattcttgttattggtctgtatcttttgttcgtttgcctctacttcccattcacaaaatatgcgggtgagcataagtaaatcaagcacacagttaaacaaaattttctctgaaatagagaaacagacggagtatctgtttgtttataacaaccagatagatgtgaatcgaaaagtttctgttaatgtaaaggagaaacaagttgtccaggtattggatgagttgttccgcgataccaatatcgagtatatgatccagggtaatcatatcgttttgtcctccaaagaaaataaacaggagacacagcagcagtcgagacgtcagatctccggagttgttgtagatgataatggtgatccggttatcggagccaatgtgctggtaaaaggaacaacgaccgggaatataacggatgtggatggtaaattctctttcgaagtgccggataatgccgtgctggaagtatcctatattggttatttgacgcaggaagttagtacaaagaataaatcgattctgaagattattttgtatgaagacactcagaatctggaagaggtcgtgattgtaggttacggtacgatgaagaaaagtgacctgacaggtgcttccggttctgtaaaagaagatgcgttggcacaacggacagttacttctttcggacaggctttgtcgggacgcgtatccggtgtgaatatctcgactaattcaggtcgtccgggcggacgcgcttccatccgtatccgtggtaactcttctatcagtgtaacgaatgatcctctttatgtggtggacggtgtgatcctgaatgtaagtacattgaccaacggaacatctccgatcgactatctgaacccgaacgatatcaagtcggtggaggtattgaaagatgcgtcggcaacagccatctacggtgcccgcggtgcgaatggtgttattttggttacaaccaagaaaggtgaaggtgtgggtacaagtattcgttacgataccgacttcggtataggtgttcttcctaaaaaactggatgtactgaatgctgccgagttcctgcaactggaagatctggcctatgcgaatgctcagaagttcgatccggaaggatggcagaatggaaactataaagatccgaaactgaaaagaactgactctcggttgttcgactctaatggccaaccgttgtacgatacagattggcaggatgaaaccatccgtaatgctttttcgcagacacaccagatatccgtgtccaatacaaaaggtggcgacagttacgggttgtctgtcggattcagaggcgaggatggtctgatcatcgaatcttacctgaaacgttattccgcccgtttctttatggatagcgagttgaccaaatggttgaaagtgggaggtagcctgagctatgcttaccagaaagaacgccagaccgactcaatgggtgatggcggtatcacggtaggacgtcagatcgtggaggcattgcctttcctgcctgtccgttatgaggacggaacttttgccggaaacaacgattatccggggatggaaggcggtaacagtccggtgcaggttgctaaagatcgtaactatacattggaaacacagactatgttgggtaatgtatatgcgaacatcactattcttccgggactggagttccgttccgtattgggagccaatatcatcaatcagaaatcgaattattatggaggtcgtcagttgatctggatctcttctccgaacggcagtgcatccataaataataaccggaataactcctggcagtttgaaaattatgtgacttatcataaagattttgcccgggcacattcatttaccggtatggtcggtttatcctggcagcatgtggataactcttcgtccacagcatcggctacaggtttcgaagatgatttcttccagtataacaacctggggatcggaacttctcctacggcagcatcgagtgccaatgcgtatggtttgaattcttatttcgcccgtgtcaattatggctataagagtaaatatttattgacggcaacagcccgtttggacggatcgtctaaattcggccagtcaaacagatatgcattcttcccgtctgtaggtgctgcgtggcgtatctcggaagagagctttatgaaaccggctactgctgtctctaatttgaagttgagagccagctacggtttgacaggtaactcggaaacaggtgcttatgcttcacagggtagtttgggtaattatacgactgttttcggcagttcgaaagcatccggtatcggtgtttcctctttggctaaccctgacctgaaatgggaaaagacttctcaggtaaatgccggattggacatcggtctgttcaacaaccgtgtaaatctggaaatggatgtatattataaaaagacgacagatatgttgctgagtgctccggtaccggcttccagcggtttcacatcgattacgaagaatgtcggaagtatgagcaataaaggtttcgagttttctatcaatacggtaaatattaccaatgaaaatttctcatgggaaacgacgttcaatatctcattcaataagaacaaggtgctggcattaagtgagggagacgatgatatttatccgggaccggatattttgtcttcaagcaataacatcatccgcgttggtgaaccggtaggttctttctacggttacaaacgtctgggaacctggggtacggatgaagcggaagaagcagccaaatataacttgcgtccgggtgacctgaaactttgggaccgtaacaatgacggacagatcaatgatatggaccgtctgatcatcggtaaaggtattcctgacggttacggaacactttccaactcattccgttataagaacttcgacttggttgtcgatctgcagtatatgttcggcaacgatgtactggatatttccaaacactcggcagaagaccgtaccggtatagcaaacagttataagacggtactgaatgcatggactccagaaaaccagaatacgatgatcgcacagatcagaccgaccggtgcgggatatacgacgaacatcgattctcatttcgtggaagacggttcgttcctgcgtggaaagaatctggttttgggatatactttcccgtctgaattgacaaagaagatctcgatcaagtatctgagagtatacggtagtgttcagaacttcttcctgatcactaaatataacggttatgacccggaagtgtcggatgcgacacagacgtttgctcaaggtatcaccgtattcggttatccgaaaccgcgtacgtttacgattggtctgaatgttagtttttaactcttaatactattattaaatatgaagacaaaatatgctttattgatattatcactggtgctcggttgtagttgtactgactttctggacgaatcgaatccgtctaactttactcagcaaaactattttaagacagcggagcatgcgcgtagcgtggttaattctatctatgcagatctgcggtattcggcaaacggcgactatggtggcaatccgtattttatgaccgatttcctgaccgggctggcaggaacgaaagtaagccagaacgtcaacatcaataatatccgtttggtcgtgaataattcggacaacgagtatagtaagagttggtggaactatgcataccgtgctattgccaatgcaaacctggcaatcacttacataccgggaatcgagatggataaatcgatcaaaagtaaatgtttgggcgaagcctatttccttcgtgcctataattatttcaacctggtacgtttgtttggttctgttccattggtattggtgccggtggatgcttcttcccccgaattgtatccgcaacaggcttctacggaagaagtgtataactcgatcctttcggacctgaaacaggcggaagaatctgatctgggctggacggatgaaaccggacgtgtgacaaaagcgacagtgaaatctttgctggcaagcgtttatctgacaatggcgggatatccgatggaaaaaggaaaggaatattatgcgctggctgcatccaaggcaaaagaggtgatcgataacggtagttataaacttttttcttcttacagcgacctgcataatattgaaatggagaataaaggggagcatctgttcatgatacagtatcagtccggtatcgtagagaatccgttccagagcttgcttttgccttataatatggacgtttcttattattcgacggaaacaggttctgtatatgcactggatgaatttatcaatacctatgaagaaggggataagcgtactgaagaaggtgagttttattatacacaattcacatcgaatgccaatcgtgaagaagttgtgaaattcggcggttattacatctataagttcttcgatatggatgctcatttgaatacggctaagagtagtcttaattatccgttgcttcgttatgccgatcttctgttgatgtatgcggaagctcagaatgaagcggagggcagtccttcggctgctgcttatgcttgtgtcaatcagatcaggcaacgtgcaaatctgaaagatttgagcggattatcgcaggaagatttccgttatgcagtctggaaagaacgttaccatgaactggctttcgagaataagatttggtttgatatggcacgtacccgtaaggtgttgaatctagcgaccggtaagtttgatgactatgtcggacataagtttgcatatggtcctacattgagttcacgggaattattgttcccgatcccgacgaacgagatcaagaacaataagaacctgaaacagaacgacggttattaaaagaatggttatttaagtagaataaaaaaggtatatttgccggttgacttttcagaggaaccggcaaatattttaataaggaacagttatgagaaaaaatgtatcaattcttttgtgtcttacctttttatgttgcctggcggtacagggtaaaacacaaccgacaaatggaacttcggatctgcgtactttgcagcagcaatttgtcgatctgaaattcgggatgtttatacactttaatattccgacttttatgagtgacgactgggctgatcccgatgccagtccggctatctttagtcctatgaaactggattgtaaccagtgggcggaagcagccaaagcggccaagatgcgttatggttgtctgacgaccaaacatcacagcggtttttgtatatgggatacaaaaacgactggttataatgttatgaacagtccgctcaagcgggatgtagtaaaagaatatgtggaggctttccggaagcagggacttaaaacgatgctttattattctatactggatacgcatcataaattgcgtcccggatttatcacgaaagagcatatcgacatggtgaaggcacagttgacggaacttctctctaactatggcgagataaccgcgatcatcatcgacggctgggatgctccctggtcgagaatatcttatgaagatgttcctttccaggaaatataccgcctgattaaaaggcttcagcccaactgtctggtgatggatctgaatgctgccaaatatccgaaagatgccttgttttacacagatataaagtcgtatgaacagaatgccgggcagcatatctcgaaagagtcgaaccgacttcctgctttgtcttgcttaccgatcaataaaagctggttctggaaagagtctttcccggtatcgcctgtaaaagatcccgttgcgatcgttaaggataatctggaacccttcaatcaggcttattgcaattttatattgaatgtggctcctaaccgtgacggtctgatcgacccgaatgccgttgagggattgaagaagatcggagagctttggaaagacgatgtagccgtaccccgacttccggcctatgatgccccgataattgcaacgaacatagccaaacataaaccggccaattccagttggagtgaggatatgatgatcatggattttggtaatgatgacgactttacaaccagttggctctcgaacaaggctgtagcaaagccctggtttgaagtggatctggataaatgccattcttttaatatgataacaataaccgaccttaagggaagtatacaacggtatcgcttgctatatgaagctgatggtatctggaaagagatctgttcgggcgataaagctgataaagttaaagtacatcgtttcgaccgtgtctggggaaacaaagtcaaaatagaaatagatagcaccaatgggcaggcttcaattgctgagttcggggtgtatgatgaacaacgctgatatagtatataaagtaaaaccgccgcgaatcacttcggggcggtttcagtctccacatttaccatcaattatgttttatttaattgttgtggaagtatcgttatttctagataaattgtattcgtatatagcaattgactacactgccattattttcaacttgaataggcagatcgtagtagcctttttgcttatttttaaaataaagcatttcaatttctccatccgaaatagtcatactttgggtgtaaccatttacaatagtaggtgttacaaatgcacaatatataggtaggacatgactgataggaaaattataaaataaaccttgtgtcggatcttgtcggatgacatcaatacatgaaccttcgaaaacaggacccttttgtgcttttgcttgtatccctaccattaagataagagaaaggataaaaatgattcttttcatgactaattagatttaatgtgttaataaattctttgtaattgagtgtggcaacattcattattgccacactcattattataaataagtttattgattatctaaccattttgtaatactctttcttagcccagaacaggttggtataataaccacttggctcttcgtaattcttggcgatcgctgcctggcagttgtcactgttgtatgtcaactcatcgttcggatagggcagacggttaggaggagtcgggtaattagatacctggttgtctgttgcaaattctacaacaggataaccggtacgacgtactacattccatgcttccagcttgttcatgaagccgaagtctaaccatagttgtgtgcagattgcttcctgtgtcggtttccagatactttcagcgtatgttgtgattgcgtcgtctgtcggtctgaccagcggacggaatcctctgtagctgtcattacctgccttgtgaagtgaacttgtctctttcatatcccaataatattgggtagatagtttcacaccttcaacgaagtgagcttttgccttgttgacatcggctgccacgccataccccatcaaataggcttctgccttgctgagactaacctctgcagcactcagccatagaccgaatatgttttcatttccctgatatgtatcccagccagcggcagcgatggtgtcgatttcacaaaaatagttggcttgtgacatacctctgtttacatattcctgatgctttttgtttgaaagattcgtgatttcaacatcagtcatcataacatcgtaagcaatgtattccccatcgggattacaatcgtacataacttccagacgtgggtcagtatttttgccgggtataccgtttgcaggtacattcatcgcattcagaactgtttgtgaacaagctgccataccacttgagcgaagtgcttgagagaatgacttaccgaagttaaattcatccttttgggtgtcggctgttactcccatattttccgtattgttgtcaatcagcggatacttgcccggattattcaggatttcggcaatggcagcatgtgcttctgttacgcaatcgccggcagttgacaaatgaagggcaatacgcaagcggagcgagtttacatatttttgccaaattgttgcatccccggcagcgattgtataatcctgacggcttaaagaagtaagaccgattgcgtccacattgccactggcgaaatagtcacctacctctttcaggttggtaagaatctgtttgtacagtacaacgtcgtcatcataaacgcatttctctttggcagcattatagtctccgtctctccaaagcgtaccggctccgttgaaaggaacatcgccgaacacagacaacatttcatgtagttgcgcttcaaccattgtacgccctaaataatagaacaccaagttagaaggtttttccgtatccgaaagattttcgtagttatattccaacaaacgtaactgagttaccatatcatagaagtttttccaacgatcgtcataacggccttcaccggatcccatatagcgaccagctgcattgttggtgccaattataccggagaaaataccggatgtggtagattgtatccaatgacgataataaattgggttcatccatgtattacctttgtacatcacgccggtaaatacctgaggaacgcctactgttgtagtcttcgagggatcagcatacttgtcatcatacgctgaatcggcgcatgatgaggcgagcgataccagtacgattcctcctgctaacaatgaaaatatctttttcataaattcttctttttaatctgatttaataattagtaagttagaagcttgcgcggactgagaaaccgaatgtacgtgcactggctgtagaaccgccgatttgtgcctggtagatccagtttgttccgtctgtcgcttcagagtcgaacagtttcaaagtacgatatacatagaatgggttacgtacgaaaccggaaaccatcaggttgttgcaagcaaactttctggtccattctgctggcaaagtgtaacccaggctgatttcacgacatttgatgtagctgtttttctggatagcatcctgataagtccgggttgcatttgttccccaaccataaagtttgctgttagcttccctttgagttacaactatatcgttcggtgtaccgtcttcctttacacccggaaggatcaaaccgttgtcccacagatagtggccgttatacatatcgccacgttggtagttgccttcaatacttgcgacttcatccggagtaagcacatgaatagctcctttgtcttccatcttttctgtctcactgtagtagaacaaaccgccggttgaacggtcacggacaccaatagcatcggtaatagtaccggtgttcatcataaactgccaagggctgttcaatacatcgccaccgaagcggaagtcgaatgccatgtctaatgtgaagttcttgtagcttaggcttgtaccgaaacctccggttacctttggcatggcgttacctactttatgacgctctgaagtgtcgctgatatacaaaccattactacctacgatgtagttaccgttttcgtcggttttccaggtataggtgtaccagtcacccatagattcgcctacatgcgattcaagaacagcagctccaccgtcgatgttggtgtgattcaatacgtccagaccatcggctagttttttcaccgtgtttttgttccatgctacattggcacgcaaatcccatttccaatccttgttttcaaaaggcgtgccatatacgcttaattcgatacctttattgctcaactcgccgacgttcatcaacatgcttgttgcccccattgaagcagcactggttgtagaaagaatctgatctttgatggtgttgctatagaagttgaattccatgcccaaacggttccccaaaaatttattttccaaaccgatttcaaattcatatttggtttccggtttaataccttcgttaccgatgcttgtatttatataattataggcataagtagatgatctcagcaaagagccctattcgaatgccaggtttgcgcgatagatttcgggggcattacctacgataccgtaagaggcacgaaccttaccgtaattccaccaagtcggcatttggtctttcagcaactctgtatagagtacgctgacgctggcagaaggataccagaatgagttattgcccttcttcaaggtcgaactcttttcctgacggatagaaccttccacaaatccccatccgttataaccgtagctggctgtcaggaaggctcctgttttaagcaattcctgtttggtcatgctcgcattctttgtgccgacggaggcgttcaagtggaaccagttttcctgtgtcagcccctgattggtactcacatctgatttgtaataggattcttcgcgagctgtccaacccaggttggctgttacgttatggagctcattgaatgttctgtcgaacatcaacatcacatcgctgtagataatctggtaacgactgttgttcaatccgtaagagtcgctgtactggccgttggtagaaaatacatgagcgttacttgcgtagtttttgttttcgattttatcgacggtgaggtcggcagccagacgtccacctaatgtcaatccggggatgatctcccaggtcgggttgacggaaccgatgaaacgctgatgttcttccaattgttcattacccataatcttccagaaatattcatccatcagtgaggttgaacccattggtgtgtaaaggaattgttcatccggtgttaaagtatcgcttgtaccgccgttgttagctgagatactgttcatgtaaccgaggcttgtcaccgtatggtcgcgtatataagcaacatcggtgaaaccattgaagaaaccggtaaagttattagtcaaacggctgatacgatacggacggttcttaatgtattggttctgataagtggctgtatagttcaacttgattgtcttgctcacatcgaatgtaccgttcaggttgaagttatgcttgtggttgtttgagttgagctgcatggcctgcgcatcgttgtaggtgtacgagaaacgtacattattatgctcagtactattggttagtgacaggttgtatgtctgatttataccggtgcggaagatgtctgcccactggttgtggtcgatcggagtgtatgcacgctgtgtaccgtcgaaataggttaccatcttgctcggatcgtatttggcaccccatgcggagtatgtttcttggttaggtgtaacgatcgtgttgccgttacggtcgacaagttgctgacggaaaccagtcaatgcctctgggttatcgttccctaaggaagagttgtcggtacctgggccatattctttctggatttcaggcatgtaggcaactttgtcgaaacttacgttggcactgaaatcgatttttgtaccagtaccagcttttgccttcttggtcgtgatcatcacaacaccgttggcagcttccgaaccgtacaatgctgaagcggcagcaccctttaagatagagatgttctcgatatcttcggggttgatatcgaccataccgttggagttgatacgttggttaccccaataatcatcattattggtgtttccgttgtgaagaggcacaccatccatgataataagcggttgcgtattacccgtgatagaggaaagaccacgtacggagatagataccgctgatgtaccgccaccgggagcagcctgaatacgtacaccggttgccttgccgtaaagtccgctagcgatgttcgaaccaccggttctggtcaattcgtcagatgatacattacttactgcataacctaacttcttggcatctttctttatacccaaagccgttacaactacttcgtcgagcttttggctgtcctcagccaatttaatgttcaatgaagcttgtcctgcataagcaatttcctgagtcgcatatccgataaaggatatctggataatgtctccgttttttactccttccaggctgaagttaccatccatgtcggtaatactaccgtttgtggttcctttgatcactactgatgctccggctacagggccgaaatcatcttctacaacaccggtcactttcccgttttgctgagaaatggcggttccttgcttctctggcgctaagtcagcataggcacttgcgggaagtgttatcgctcctgcgataagaattaagctgacaggtttgaagtgtttcaacataattaatgagtttatagataataatactagtgttagtggagttaccttagatttgacgtttattgatgtttttgatcttagttctaaaagtactaaggctatcctggtctcataacattattattattaggtatatacggattgttaagtctgattaaaaaaacttttttacaaaacagctgttggagacttgtgattgattacgttctttgcagttaataaatattgtgtaaattgataaggtgtaaattgtggttgatatatcggattataatacgaataaaatatacaatatgaatataatcaaagggtaaagtttgtagtcggattttccggttattatatttgctctcttattggaagtgttaaaaacaaagcaaaatatcacttttattgacgtaaaataacaatacgtaataaataattaatacatttgtgccagatatttagtacggagttcttttagaactaaggtgctatttatgattatgtgtcctatttttttgaaaaaaatcttataactatagttgggtgtagagatctataatatagaaaacaaaaagagcggaatgcgccgctctctaattgtcaattgtagaaatgaaaatgtgaaagttaactgttgcttttttgataaaccccaatagccttctttattgacatcaatccgaaatcgtcggcatttaactcttcttttttcataataacgatttcggcagcatcatcttctgcatgaacattgttgaagttttccacatggcattcgaaaaacatgtctactgtgtgcacttcaaaaccactatacatataaagattagggatagaaaacagataacggcatttggtaatatccagtcctgtctcttcttttacttcgcgatgaactgcttcttccgccgactcgtacatatcgacaaatcctcccggaagatcgagtgtgcctttggccggatctttggcacgtcgtactaatagcatttcacctgtcgcattacgtatgaagcaagcgacagctgacgaaggattgaaataataaacaaaaccgcatgttgtacactgtttggctttttcgttgcgttctacgaatgttttggcaccacatttgggacagtagacgaactgatgtaaaggatgactcataggataggtttattataaatgtatataaatgaataagggcggcttgaagccgcccttgatccggggcagaccccctgtgaaatacgattactcttttacttcccaacctaaagcgctggcacctaatacggcggcatcgctttctttcaattgagagaaaagaagtttagttttaccttcgtatactttcagcatattcttttccatagaacgtttgatcggattcataatcagatcgccagccttggtaagaccaccgaatagaataatagcttccgggcttgagaatgcaacagcatcagcaaaagcttcacccaggatatttcctgtgaattcgaagatttcgagagccagcttgtcattcttcatagctgcttcatatacatcttttgaagtaatttcgtccgggtcgagttcacgcaacaaactgtcgtccttgcggatttccagatattcgcgtgctgtacgagccacacctgttgccgaagcatacgtttccaaacatccctgacgaccgcaaccgcaaggacgtccgttgttacgacgcataattacgtgaccaagttcaccggcaaatccatcgtgtccgtaaaccaggttaccaccgataacgataccgctaccgacacctgtacccaacgtgattacgataaagtctttcagaccgcgtgctgcgccgtaagtcatttctccgattgcagcagcgttagcatcgtttgtcaatgcaacgggaatacctccgatctgttcgctgatcaactgtgccaaaggaattttgcctttccacggaaggtttggggcaaattcaatacagccgttgaagaagttaccattgggagctcctacgcctacacctttgattttgtccggacctccggcctgatcgattactaatgacagaccctgaccgagttcggtaacataatcattgatatcactatatttccctgttttgattgatccactgtacaagattgttcctcttgcatccacaacaccgaaaacagaattggtaccgcctatatcaatacctactacataaggcttctccatgattttatatttatgattaataatgagttttctggaaagcaaatataagaggaatatggttagctgcaatgattttcttcaaaaaaatgtagaatgagattcgttttagaatattacgataaatgtaagtttagttaattacaggatcaaaatatgtcattttcagctttttcacctcttcagatagtgctactttcaatgattgttttatctttgataaattcttaacccattaatgaataacactatgccacaggtttcagacatacggttcatggtcagggcagaacaacctgttttatcggctcgcatgaaaatcagctacaaagaattggaaaggcagtttgccaaaaagcgcgaagatgtgctagctcttctccgtcctaccggagtatatatgaccgatgttccttttattatttaccacgattatttgaatctggatgtggaaaacctggatttggagatttgttttcccctctctatctggatggatggtgatgaaaacctgcaacctcgtatcattcctcagacgaaagtggttcattgtatgttcaaaggcgattatgaagagatggattatttgtacggagaaatgactgcctggatcatgcagaagggatatgaaccggaaggttcggcctacgaattctattatataaagaaagatcaaccttatgatgaaaggttgaccaaaattgtattgcctgtaaagggctgatacaattttggtagatggacagtttgcccggttttatttagcaggcaatacctcgatccagtaatcgtccggatcgttgatgaaatacaatcccatatcggtgttctcataacatacgcagtccatttctttgtggaatttacgtactttgtcgtaatcaccggctacgcgaaaacagagatgactttcgttatctcccagttcgtatggttcgttgcgatctcttagccaggtcaattccagtaggaaaccagtttggtcgtctgtcaggtaaacaaggatgaaggagccgtcggctgcttcttttcggtggtgttctttcaatcccagcgccttgttatagaaagcgatacttttttcaaggtcgagtacgttgatgttgaaatgatcaaatttgcctttaatttccataattgttttcttttaaattaaaaatcagtgccttctccggggacggacaacaatatatagcggcatcctttcgactctgcataaggtccgaaagccatcacttcggccggccgttcccagaaatgcatcggaactaatacatccgtttttattttatcgataaattgttcggctccacgcataaagtccgtgccgatacgtggatcgacgggaaacatagccagatgcagatgttgtgccgtttgagccagtgttgtcagttcatgcagataatcgccctcagcctttgccacctcttgtggggtagactcgtctttccagtgccaattgttgaggtcgccagcatgaaacaacagtttgccttctgcttctatcaggaaagaaataccgatgtcggtcgagccgaaagcctgtatccgcagatgttcgtcttcgaatacgtctccctttttcaaataagttgcgtcctcggcgtttgcacgtttccgtttcaggatatccttggagaaaatatatttgatatccggttttatctctttccactttaggatatccgggttgaaatggtccggatggaaatgggaggacagtatatataatgtacctgtgcgatgaagcagttcgtcatggacgaatcctgtgtccggtgtcttgcccgtgtctttaaaataatcgatcaggatcgcatatccttctccttcgatggcaaagccactatgataaatataagtaagtctcatactgtattcttttttctcatgtaaataaaacatgataccaggtgattaagttgcttcctgcggtacaaatatacaaaaggatggggtgatttggaaaatagtaggcaatggaatgtaaatatatcttgagaaatgtactttttgttaccaacctgattggctgccgataattgtcaacaggcttgtcgataattgtgggaaagcttgttgacgattgtgagcaggcttgttgataattatcggcagccaattacttcatgaataaaatatgaaactgtcgctgataagtattggtcagaatgttacttttgtaggataagtatagtatctggtcttgattgtcggttggtattattttattaattaatacttaaaattgatggaagatgcagtaataataagaataatcagtttatttaataagttttatgtgtttacatggtaataaagcaatagttaatataatgtaataattagtaccttgtgatacaaggtatcttatataaatatacatttgttccgtcagagaataaaaaagttccttaaacatgtaacatttttagcaatgtgtacgtctaataataaaaagaaatgacagatattatgattcagctgaaaggaattaacaaaacgtatttcaatggtgctccgttgcatgtcttgaaaggtatagacctggagatagaaaagggagagatggtttcgatcatgggggcttccggatcgggaaaatcgacactgttgaatatattgggaatattagatacttatgataccggtacttatcatttgaacggacaattgattcagaacctgagcgaaacccgtgcagctgaacttcgtaaccagatgatcggttttatcttccagtcattcaacctgatctcttttaagaatgcgatggagaacgtggctcttcctttatattatcagggagtgaatcgcaagaaaagaaatgccatggcgatggagtatctggatatggtcggtctgagagactgggcggagcatatgccgagcgaaatgtccggtggacagaaacaacgtgttgcgattgcccgtgccctgattgccaaaccacaggtaatcctggccgacgaaccgaccggtgcacttgacagtaagactacggttgaggtaatggaacttcttcgcaatgtgaatagagaaggcatgactatggtgatcgttacccacgaacaatccgtagccgatgcaacagaaaagattatccgcgtcaaggatggtttgatagaaaacatagaaagaggaaaagggtatgttcgactttgataatttccgcgagatatggagtacgatcaaaaagaacaagctccgtacattcctcaccggcttttccgtagcatgggggatttttatgctgatcgtcctgctgggagcaggtaacgggatgaagaacggtattatgaaaaacttcgaccgctgggcgggaaaccgtgtggagacatggcctcgctttgccagcaaaccttataagggaatgcagacaaaccgacggatcaagtataaggacgatgacctggtggcactgagacaacagaatccggaagtgaacctggtatcgggcattctttatcaaagcgatacgctttcatataaagaggaatataatacttattcgttgcagggagtccatccggacaaggctataatcgacaagatcacgatgacggtaggcaacggacgttttattaatgaagtggatgtcttgcaaaagaggaaggtgatcgttatcagtccgcgaatgaaggaagtccttttcaggggagaggatccgttaggaaaatatgtaaatgccagtgatattgcttatcaggtaatcggtatctataccgatgaggataataacaacaatgctccggcctatatccccttttctaccgcacagcaattgtatcgttcgggctatggcctggataatattatcttctctctgaatggagtcagtaccaaagaagaatatgaagcctttgagaaacgtttccgtcagcagatgggaaaacgacattattttgacccggaggatctgcgagcgatcggtatgtggagtacgattgaagattttgccatgtttaacggtatgctgaacggtattaccttgtttatctggattatcggtataggtacactggctgccggtatcgtgggagtaagcaatatcatgttgatcactgtacgggaaagaacccgtgagttcggtattcgtaaagcgatcggtgccactccgttctccattctgaaactgatcattgtggagtctatcctgataacggcagtgttcggttatattgggatgataaccggggtaggactgacggaagccatcaatgccgtaatggagagtaatagtatgggacaagcctcgtcgaatgatgatatgagtatattcctgaatccgacagtaagtctgagtgtcgccttgtctgctacccttttgattattgcagcgggtgtgttggctggttatttcccggcgcgtaaggcagtgaaaattacggctatcgaggccatgagaaacgaataaaaacagaaagatatgttcgatatagaccgttgggtggagatatgggtgacaatcacccgcaacaagaccagaagttttctgaccgggttcggtgtgttctggggaattctgatgctcgttatcctgctgggttccggtacagggtttaagaatggggtattgatgggagtggacggttttgcaacaaactctgctttcttcttttccgagcgtaccggcgaagcgtttaaaggatataagaaaggacgttattggcagatgcgtaaccgtgacctggaaacgatccgtcagcgtgtgaaaggggttcgctacctctcgccgatggccatgtcgtggggcggacagaataatgtggtgagaggacagaaggcgggtacatataatgtacgtggtgtgcactcagaatattttcagattgaaacgcagcatgtgctggaaggccgtttgctgaatgagatagatgtattggaaaagcgtaaggtttgtgtgatcggaagtattgtccgtgaagtattattttctccgggcgaagatccgattggccagtatatccgtgtaaacggtatttattatcaggttgtcggtgtggtaaagcccaaaccgcgcgtacagattggcggacgtacggaagaaagtattatgaccccttttacaaccttgcagcaggtggctaaccagggagataagttctggttcctgtgtgctacggcagaggatgggtataattgtcaggagatggtggatgatattacgatggtgctgaaaatgcagaacgagatttcaccgaccgacccgcaggctgttagcagttttacgatagccaagcagttcgagacattcgatatgctttttaccgggatcaatattcttgtatggctggtggggatgggaacgctgttggccggcatcatcggagttagtaatattatgatggtgactgtccgggaacgaacccgagagatcggtgtacgacgtgctatcggagccaaaccgttcgatatcatttcccagattatgagcgagagtttgttgcttacggctttggccggattaatgggactgagttgtggggtattcctgctcgatgtggtgaacaggatgctggcaagcggcggacaagaggctaataacggcactttcttcagtaacccggagattcatatcggaactgcagttgtcgctacattcgtgttacttatcagtggcctgatggcaggattgattcccgcctggcgagccatgcagattaaagctattgatgcaatcagagaagaatgaatataattgaaagttgaaaattgaaaataagataaatcatgaagaatcgtatcgtaaagaaagtcctgcgaatcatctttttagtattggtgggagccgccgtgatcggcactttctacttcttgtggaaaaaatcacaacctgttattactgtttatgaagtagtaacgcccaagcgcgactccgtggaaacgaaaaccgtagcaaccggaaaggtggaacctcgcgacgaagttcttatcaaacctcagatgtcgggtattatttccgaattgctgaaagaagccggtcagaaggtgaaagaaggcgagatcattgcaagaatcaaggtgatcccggaaatggttcagttaaacagcgccgaatcgcgtgtgcgtgtggctaagatcaacctggaacagatcacagccacctataaacgggatgaagaactgcataagcagggagttatcgcgaaagaagattatgaaacatctttgtccaactataaaaaagcacaggaagaagctgaaaatgcacaggatgcattggaaattatccgtgaaggtatttcccgcaggtctgcagcttccagtacgacgcaggttcgctctaccatcaccggtatgattctggatgtacctatcaaggtgggtaactccgtgatccagtcgaataccttcaacgatggtacgacgattgcatctgtagccgatatgaacaatatgattttccggggaaaagtggatgaaacggaagtaggccgtatccatgaaggaatgccgatcaaattgactgtcggtgcactggatagtcgtacgtttgatgccgtattggaatacgtggctccgaagggtgtggaagagaacggcgccgtgatgttcgaaattaaagctgccgtacagatgcccgaagatgcctttatccgtgccggttacagtgccaatgccgagattgtgttgaaacgtgcgacagatgtaattactgttcctgaaagctgcgtggagttcagcggcgattctactttcgtgcagatcgtgacgcaggagaaaccggaacaactgtttgagaaacgtcctgtaacagtcggcctgtctgacggtatcaagatcgaagtaaaggatggtttggcagaaaatgataagattcgtggcggtattgttgctccggataagaaataaaatttaaacgaataagctatgaaacaactaatatcatccgtagcgctggcttctttccttttctgtctccctgcgggagcacaggaggcacctaagcagtggtcgctggaggaatgtatccgttacgctattgaaaataatatcgacctgaagcagaaagaactggaacggcaaaaccaggaagtaacgttgcataccagtaagtatagctggttgcccagcctgaatgccagcatcggggagaacttcggttttggtcgttctgaatcgaaggacggtctgattgtagaccgtaactcggcaaatacgtctgctaatattcaattgagtatgcctgtgttcgatggttttaagatccctaacgatattgcagcacgcaagctggacctgaaagcatctattgagacactgaataaagcgaaggaagatctctctataaatgtggcttcttattatctgcaagtactttataataaggaaatgttgaagatcgccgaattgcaggtcgcacttagttcggaacaggtaacaaagacggaagcgctttataatgcaggaaaagtccccgtttcgcaactttacgatatgaaagcgcagttggcaaaagacgaggtcacactgaccgaatcgaaaaataacgtaaaactggcattgctcgatctgactcaaacgcttgaactggaacgtgatggcgaaaacttcgacgtgcttgaacctgaaactggtgatgcagttgaacaatatatgagcagcattattccaccggatcaggtgtacgactatgcagtcggtgtcaaaccgcaggtcaaggaacaggaatacttgcttgaaagccagaagaaaatgctgaaggtggctcaggctggtttttatcccaaactgaatttcagtgcaggttacagcaacggttactatcataacttcggtgacggcgattataataatgctccttttagtgatcaattgaagaataacggacagaaatcgatcggtttcagtttgagcattccgatctttaaccgttttcaggtgcgtaacagtgttcgctctgcccgaatcgctatccataatcgtgagttgatgatggagaacacaaaaaagacactttataaagagatccagcaggcctattacaatgccacagcggcacaggagaaatatgtgtcatccgacaaatcggtcgatgcgagtaaaatagcattttcttatgcggaagaacgttatggagcaggcaagagcaccgttttcgaatatagcgaagcgaaaaccaaatatgcacaaagccttgccgaacaaacgcaatcgaagtataactttatcttccgggccaagatactggacttctataacggaacaccaatcaccttataatattacagttggattttagatcctattttaaacataattgatggacacaccaagagggagggaggtttccgtgaggaagcttcccttttgtttttattcagtaaattctgttcaaaagaagtgaataaatattatatttgctgcataaagcggagatttaattccccaaaagaacgagtccatgaagaactatggaatagttagcgtactattcttattgaaatcaaaggataatgtgataaagaagataatgtgattttttttataaaaaaaacgaaagtgctgattcttatttatatacaaaacagaagcggacatagttcttcatgaactaatatttattggaaaaagttgcaggggtattttatgaacataaaccatataaataaagaggtaattgagcagattagaaacggctcggaaaaagcattttccgagttgtatagtgcttattatagctatttgaatgctgttgctttatgttatctattggataaaaacagtagcgctgaaattgtaaatgatgtttttgtcaatatatggaataagagacaaaccttatcttatcctatacattattatttagtccgttctgtccagaacgggtgtctcaattacatacgaatgcaaagagcgcaacaaagtgttttggatgaacataaagaccaaatgttggcttttcaggaaaattatatccaatcaacaccggttccgctacaatatgtggaaatgcgccagacggaagaagagatacgtttggcagtaaatcaattacctttgaaatgtcggcaagtctttgaagagtatttttatgcaggcaaggaagttgatgttattgccaatgatatggggttgactgtcagcacagtacgtgttcagttaaagaacgcaacagatcgtttaaaaccggcattaaaacatcttctatttcttttcttttattaaaatcaaaaaaagtttgattttatctaaatgttttccggttgaggtgtgtattaattctaaacaaccggaaaatttagcagtatatgcaagataaagatatattatttgaggaactaatgagtaactatatttcaggttccataacggacgaggagaaggtttctttgttcgctttggtagagggatcggatttatacagagaacggtacaacgagatggtaaagttgtatgcacttcttcatgttcccgccttcgaatctcagaaagaaaccagatatgcccatttgaaagaaaggttacatataacgtccggagctactttacggcgccgatggtttatctatgcacgaaacgttgcagcagtccttttattgatggtttctgtttccatcggttctatttttacatacaatgaattggatgaatcaggcgagctgctatataatgaaatgacggttcctttgggttcgcaaaccaaagtgattctaccggacggttcaacggtagtccttaattccggctctgtcttgaagtatccgttatcatacgggaagaaagagcgaaacgttcatttggtaggtgagggctattttgaagtggctaaaaatgtcgaaaaagtttttcaagtctatgcaggtggtatgcaggtgaaagtgaccggaacgacatttaatcttcgttcgtatccggaagactcggagacagaagtggcactgatcaatggtggggtagatgtattggctaataataaacaagttcgtttgaaacctgatgaaaaagcgatatataatcgtgaaacgggtaccttgtacagcgaaacgactgagtcgcgtaaatcatctttatggacgacggggcggttgagttttgtgaatgcttctttccttgatatattgaaagatatagagcggaaatataatataaagatccatgtagagagtaaaaaagcagcagatgagtatttcaccggaagtatcaacctgaccatgtcacttcaggaagtattcaactttatcgacgtggataagaaatatcgttttgaacagagtggaaacgtaataatgttaaaggatagatgaaactgcgattaaaatatgatgtttaactttaaaagagtatttatggaaaacaccggttaaaaaagaatcggagatggttggcacttctctccgattcattagatgattttttgaattaattagttgttaactaacaaagtcgttacaaaagtatgaaaagaaagtatttctcaattaaacaattgggtttatttttggcgatgggggtaatctcgacttctgtatatgccaatacggcattacaaagtgtaaaagttactgtacattacaaaaatgcacctatcagtaaagttcttgatgacatagaacaacaaacaggttattcaattctggtacgtaataatgatattgatatcaaacagaaggttacggtaaatgtgacggatgaaactttaaatcgagtcctgactgatgtttttgaaggaatggatgttaagtatgatgttgaaaatggaacaatatctatttataagccaaaagaaacttctgttataacaacagtagtaaaccagaataaaaaaacaatttccggtgtaatttttgatccgaacggtgaaccggtaattggagctaatattgtggaaaaaggaactacagataatggtacgatatccgatatcgatggtaagtttacattgaatgtagataataattcaactctgcttgtctcttttgtcggttttaaaagtatggaagttccggtaaaagggaaaaatgcattcaagataacgatggcgaatgatacggagttgttggatgaggttgtagtggtcggttatttgacacagaaaaaaacatcgttgacaggagctgtctctagtatgaagatggaagaaaacctgacaaccattccgacagcctcggctgcaaacttgctggcaggaaaaatggcgggtgtcaatatctcttctaaaaacggacttccgggtacaaatccgaaattgcaaattcgtaccatttcttcctggaaggaggaaaaagataatccgcagccggtaacttatgttattgatggtgtcgtcagggatgctacgtctttcaatgcgatgagcgcgaatgaaattgaagatgtttctgttttgaaagatgctgcttcggctgccatttacggatcacgttcttccggtggcgttgttatcgtaacgaccaaaaaaggtaagatcggtaaaccgactatcaactattcatatggtttttcagttgatacacgtacaaagagttacgatgtgacggatggtgtacaaacagctttgatctataaccgtgtcaatcctgaatctccccaaaaatggacggaagaggaaatcgaccatatgaggtccatcaataacggttatggatataaccaattggatgaagtgtatcagaatccgaccactcagacgcacaatattaacatctcgggtggtaatgaccggattcattacttcggtgcggcttcctatatgaaacaagaagggttcctggctccgcttacatacgataaatataatatacgtatgaatgtgacggccgatgtgaccgatgattttgaattgtatacaggtttctcattgacaaatgacaagatcgggcgtattgccagtgacggtactgattgggcatacgatacgtatggaaaattacgtatctggcaaccggaacaacctgtgtttacggatagtggtaaatttgtggattatggttggattgccaatgtgggtgctcgtgtattgggggatgacggatatcgtcatgataaacgactaaatccgacatttactgtaaaaggaacatataaaatgccatttttgaaaggtttgagtgcaagtatccaatacaataaaacctggacgcataatacggtaaacggatattataccaactatgatatgtatattaccaaacatactggtgctaacggacgtattatgtctacacgagatgaggatattgttggtgttaaacggtctagtcaatatggcagagactatttacgcaaagattctaaatggggagacacacaacagttgaacttctatttgaattatgccaatacatttaacgaagtacacaatgtggctgcggtattgttgacagagtggtcggaaggttttaacgatagtgtatatgggttccgtgaaacattcccgttctatcagacggatcaattttgggcttttgctagttctcgtgagtttacatccggtggtggagatgtttcttcaaagaacgggcgtatgtcttatgtagggcagttcagctattcgtatgccaacaaatatttgttaggattctctttccgtgaggacggatctatgaattttgccccgtctcagcgctgggggttcttccctgccggatctgcaggttgggtattgtctgaagaaagcttctttaataagaaatggattcagtttatgaagattcgtggttctgtcggtctgaccggtgatgactctgtcggtggatggcaatggcaagaatcctataaaagttcgggtgatgatatcaagaatgcttatttcggtaagaacccatccaaagtggcaggtatgagttacggtagtgtggtcaatccgaatttgacatgggaaaaggccttgaactacaatgttggtttggatatgagcttcttagatcattggaatttgagtgccgattactggttccgtaagtcttacgatatcttggataaccgccaggctacattgcctactactttcagtcgtgatatgcctgctgaaaactatggtaagatgaatgcgcagggtgtagatttccaattgggttataaaggaaatactcgtgacttcgactatcatggtaatttgactgtatcttatggttggaacgaaatcaaatataaagactacgctgaaaatgctcaatggattgacgttcctattggtacgtccacaactcgttggatcgggtatgattttgaccgtatcattcgtacacaagaagagttggacgctttcaacgcagagcatccgaattattcattccaagggatgaagcctgaattaggtatgatggtttataaagaccataccggtccggacggaaaacccgatggcgttgttgatagctgggaccgtgtcgtattgcgtaacaagaacttccctgttcagtatggtttgaacttgggtggtagttggaaaggcttgagtttggatatgatgttctcgggtgaattgggtaaagaccgttcattccgtgatctggctggtaatgtggaatggaatcgtgtgtggaatgagtggtacgacaatagctggacgcccgaaaatccgaatgccatgctcccgaaacaggtaagtgccaatgctccgagttcgtatcggaatgatgacagtcagttctggttgaaaaagaccaattttatgcgcctgaaatacattacattgagttatgacttgccgaagaaccagttctataataaactgtttgataatgtcagattgtttgtgaccggatcgaatctctttgtatggagtaacttcaaatattatgatccggaattggataatggtaatgcttatccgattatgcggtcattcaactttggtattgatgtgaaattttaaatctgaagtaaacaatgaaacgaatcaaattattagcaggtctgctttctgtctttttgatgtatggatgtagcctggattacgaaaataaaggatcgatcactccggatggcgtgtggaacaacccggagatgattgatgcatttttagcgaatatttatggtaacatgatgccggggtggccgattgcgtcaaacaatacggacgaaggtatgaatggggtgacggaaatggaccagtatgtgcgtggtgaatattcagtggataaccacggacagggactaggttatggtaatatcgataagatcaatttcttcctgactaatttggcgacggtcgaccaagctgtgctgacaaaagaagaaaacgaccagttacgtggacaagccctgttctggcgtgcctgggattattggggaaaggttttcacgttgggtggtgtccctttgatcctcgaaattcaggatgtgtcggatgttaattctttgttactccctcgtaattcaacgagcgagtgtatggctcagatcctaaaggatttggatgaagcgattgcattgttgcccgatacttgggatgatgccaattacggtcgtatcgataaaggggcggcaatggcattgaaaggtcgtatcctattggcatacgccagcccgttgttcaatccgaaccacgatcaggctcgttgggaacaggcatataaggcaaacaaagatgcggtcgatttcttgcaaagtgtaggtaaaggcttgtatcaaggcaaatatgctgatatttggtatgatgagcaaaattgtgaggtgattatggtgaaccagttctatggaccggatcattatctggatcagaagaatatccgtccgttgcctcttacaaaggatatggctgaacagaaccaggctatcttgccgttgttgatggctttcccgaaagccgatggaacaccgttggagttggatgtaaatcgtttggctgatccggattataaccacaagttcgtcgacgaattttataataaccgcgatccgcgtttccatcaggctgtattttgcccgggtactgaatatccttgtgacgatattcttactggtggtaaaaagtattggaatgcttggagggtgatggatgatggtgcttatgcctctatttttatggatgaaattggtaagggtacaggagttagttctaatttctatcaacggaaaggtttggattatgatgtcaatgcctctaaagtgtatgaagcagatgtcgactggattgaaatccgtttcactgaagtgctgatgaattatggcgaatgtgccaatgaattaggaaagagtgctgaagcgttgcaggtattatatgatgtccgtaaacgtgccggtatagaaaacacagccggtaactatggtattacggctacttctcaaagcgatatccgtgaagcttatatgaatgaacgttacatcgagttggtttacgaaggtaagcgttggagcgatttgcgtcgttggaaacgtttcgacatcctgaacgacatgaaatatcgttcatccttatggctggttattgatgattacaatacagtggcatccggcaatttcgattggtcgaaagatatgtttgatccggaagtgaacaaaatgttccgtttcgactatatcgaatgtgtggatggcgataaggcgttgtggcgttttaatctggataataaccactggttctatccgatcaagaaaaatgacctcgatcgtaattctaaattagaacaaaacaatgaatggggcggtacttttgacccgttgaaataagtgtttgatttgaattgattcactaaagcatgcagattctatctgtaaagatttgtctgcatgcttttttattttgcagaaaaaataaaactaagtgttaacctatatgacaacgctattacggaagtaaaaggtgactatgtggctaaacgtaccgaataccgcaaagaaactattgtgaacatcctggatcttgccggccaggagaaggtcaatgccatcgccgaaggcaaaagtgtggtggctggggttggctagtatctggtgaatgtcagcgggtcgttcgactgcgagaaagctccgttcaatcccgctatccataaattaggtgtttcttatacgccgagtaagttgttgcgcgacacgttgaagaatgttatcgttgaaactcgaccggccgttaccggaccaatcatcaatgatattgtcgatactacgacgggtgagaagaatttgcagttgacctcttccggacctgcggtcattacagggacaaacatcaaggtggcaggcgacgacccgacggtgggtatttatcttaccccaacggagggagatgccaagaaagtggctttgttgatacacaacaacccgtcgcaggttacattcatgcttccggtgttggctgacggtgaatacaaattgagccttacgacacagtatagtgctggtaacaacttggtgaaggaatcgcgtacatatactttcccggtcctgctttacgtgggtgatgtaccaggaggtgatgacgatgaccgtccggtcatcgaataagcagcagggatttacttacacggtctaagttccctagacttagaccgtctcagtctagggacttacttttccactgttcggcagggaataataatccactgaaaaggcagttttttgctattttgtgaaaaaggggcggttgatatatttgttaagttcaagaagtgacattcaaatgagttttaaaagatgaataagattgtgtgtttgattgcggtatttcttttgtgcggacaattgtctgccagggaataccatgtatctgtaaaaggaaaggatacgaatgtgggtagtttgtcggccccgttgcggaccatccaagcggctgccgacaatgcgatgccgggggatgtgataactgtacatgaaggtgtttactgggaacgggtcgtcccaccccgagggggcgagtcggacgggaaacggattgtttatcagtcagctgagggtgagcaggtcgttatcaccggctcggaacgggtaaaaggctggaaaaaggtgttgcataatacctggaaactgaccttgcccaattcattcttcggagagagcaatcctttcgatgaacagatttatggtagctggtatcggggtaaaggcagacccaatcataccgggatggtgttacacgacggtaaacgtatccgcgaagcgttctcgttggatgaagtgctaaaaccgcttgatggcaaacaaccgtattggtatgccgaagccgatggcaacggtggcccggtgttgatgaacttcgaatgggtacaaccgatgggaggggaacgtaaaacctctatctctgcttctgtaaaaggaggggatgcggctatctgtatcgctattgtcaaccgctggcctttcggttatctggaagacggttctgagatgtatttcgaccaggtggatttcggaaagggaacggatacattgctcttccaagctgccaccctggcgaaaggcgggttggtggaattacatgtggattcgccggccggtgaatgtttgggtacggcgcaggtgacgaatacgggcgactgggagaagtttgctgaatttcgtttaccgatgaaacgctcattggagggaaagcataatttatgcctcgttgtccgtgctccggaaatgccggaagacgggaagacgaccatttgggcacagttcccggcgggcgtgaatcccaatcgttcggatgtgcaggttgcggtgcggccgcaagtcttttatccggacaggacagggatagactatatcaccgtccgcggatttatcctggagaataccgccaccaactgggctcctccctctgccgaacaacccggtctgatcggcccgcgatgggctaaagggtgggtgatcgaaaataacatcatccgcaactcccgttgtaccggtatctcattgggcaggccgacttatggccattcccaccattaccgcttcctgcctccgcgcatttatccggaagcggacggaggacagaccgaacagcagttgctggactatttcaaaagtgcttcctgggataaagaggatgccgggttccatgtcatacgcaacaaccatatctacgattgcggacaagcgggtatcgtgggatgtagcggtggcgcattcagtgtgattgagggcaatgagattcacgatatttgtgtggacgagactttcgaaggcgatgagatggcgggtatcaagctgcactttgccgtagatgccatcatcagagacaaccatatctataactccatacgtggtttgtggctcgactggggctcgcagggtatgcaggtgacgggcaatttgtttcacgacaataatgtactggaggatatattcgtagaggtttgccacggtccgatattggtggctaacaatatcctgttgtcagggacttcgttgaatttgtcacagggtatcgccagtgtacacaatctggtgacgggcaaggtgtctgccggtatggaccgttgtgccggtggtcgttattccttcttttatgaaccacatggtacggtttcgatcggcaatgtccgtaacatgggaggtgacttgcaatgggtcaacaaccattttgcccggaaggcttctttgggtaactgggacgaatgcctgctgcccatccgttacaaaggcaacctgtttactgacggggcgcatcccgacaagcatgaaaaagattttgtggatgcttccggctttgattctgctatccggttggaacaacgtgccgacgggtggtatttgaagatggatgtaccccgggaaggaatcacaaatacgcaatgccggttggtggctaccgaaacattggataaagcaatcatcccccaacaggcgtttacgaacccggatgatagcccagttgtcattgacaaggactatttgggaaacaaacggaatgccgtgcatccttgtccgggaccgatagaggtgaaaaaaggtggtgtacaagaatggaaggtatggccgaagaacatttgaataaaatataaatatgaaatacaaactgttagtattagctctcggtgctattgtttccgtccaaacaggagcggaaaaccggaagtcatggttgcccgatggacagcccgctgcaaacaacatccgtttgttggagtgtacatacgataaagcactcttgaaacagtgcgaagaaattacaccggcctcttccgattgggaggtgagtgtgacaggtgatttggatggacatgcatctccgtatggaacggaatatgtctatgaatacacattcaaggcgaaacgggccttgcagtcggcaggggtagcagttgctttcgaccgttataactggagcagcgacaattacgtaatgattccttcagttgtatataatggtaataggcaacgaatagtaaaccgtcagtatgcaacagggttggacgagacggattacagaagaccggatttggcattgacatccaacccgattcctcaattgtcgccagagtttggtgcgacgtcccggttggaagtgcttgtaaataatgcagctactccggctattgcttggttggaacgtgctcagcagaaggggtatgttttattaaccgatcagggaatagaacagaatggcacgatttacgaccatgctttaattgtagaagaaagtcccgatcgttctctggcttcgctggtggtcagtgcacccggagtacgtgaaaaaaggctggagtttatcggtttcagtgagagtcgtgaccgtggcctctctttcccaaaaggggaagaggtgaaaatacgggtccgcttgtttgctttcgatgcaccggctgtgcctgccgtgctggaccgtttccataaggtgcgtaaattacaaaccggagagaatcatccgcgtaacctgaaaccggccagcgaggtgatgcgtttgatgacctccaatattgaccgccgctatatgaaatgtgacgattgggagttttatcgtccggaaaatgccgattggatctctttcggatggatcggggggatgatgaatacttatcccatgttggcattgggcgacgaggagcatttgcagaaagtgaagaacacgtttgacttcgggttgaaaggtcagggaaaagctgggtatttccatgatttgttaaactcggacggtaaggtcttgggaggattaagggataagccggaggtctctttggttcgtaagaatgcagatatgttgtactggatggtgaaacagttcatgttgttgaaagcgcaggataaagccgacgcaatcaatccggagtgggagaatagtatcatgcgattggcagatgctttcgtgaatacctggaataaatgtggcgaactgggaaattatatcaatgtggaaaccggtgacatcgaagtctataattcgactagcggtgccatggccgtggcgggtctggcattggcatcgcaatattacgataaaccggagtatctggttgttgccgaacagattgggaatgtttattataaagagttttcacggattggttttacttccggaggttgtggggatatccttcagaatgccgactcggaaacttctgtcgcttttctgacctcatgcaatttattgtatgaactgacccgtaaaactgtttggttgaaaagggcgcaggatgttgccgatttatgttcaacgtgggtaatttcttacgactatgtgttgcctaaggagactgaattggccaaagtggatggtcgtctgaccggtgccgtatgggccagtacgcagaataagcacagtgcaccgggcttttgtacctcttcggcagatgcgttgttccgtctgttccgtgcgacaagtgatttacgttatgcggacttgatgcatgatgtatggcatggatatgtggaaggaatcactccgaacggttttatttgtgaacgtctgggcttttgtgatgtggaactcagaggtactcgtctaaatggagacggaggcaatggttggactgagttgaacggttgtatgatggccatggagttgccgggtatctacatccgtccggagaagaatctcttttatgccttcgaccatgtcgatgtcaagctcatcaaaggcaacgaccgggagatggtattgtcgatcactaataccactccttttgacgccgaaatatccgttttaagtgagagcgaagccgaagcaactcaacctttgtccagcgtctcttttgtaaactggaagaagataaaggtaaaagcgggtaagatgatagagtatcgtgtaaaaaaataataagatatatatgagtttgaagttatgtttagccatcactttgtcgttgatggcaagttatgttgcagaagcgcaacaagtctggactccggataacgtagacggaacgtttacgaatccgatcatgtggggcgattggcccgatccggatgtcgttcgggtggacgataagttttattttgtatcgaccagtatgaattatgtgcccggttgcccgattgcggtgtcgaaagatttggtgaactgggaaatggcaggatatgccttggaacggtatgatgaagacccgcgctttgatatgcaaggcggtacgatgtatatgaatggttcttgggcggctaccatccgccatcataacgataagttttacgtcggtttctgtacgcccaaaggatggggaaataaagaagggcatttctcgatctgtatagccgataaggtggaaggcccttgggaacggacgatattcccggagtacttgtatgatccggggctgtttttcgatgatgacggaaaggtgtatgtggtacatggacaacacaagttgtttattaccgaattgaatgccgatgtgaagtcggttaaagggaagccggtacagatctgggagaaaggatttaaggatagcaggacttggggaccgaattttggaatggaaggctctcatatgtacaaaataaatggtatgtattatatcacttgtccggcaggaggtacggaaggttggcaggtctgtcttcgttcgaaaaatatttacggtccttacgaacataaggtgattgtggaagatgcgacatcttatccgccgaacggattacaccaagggggaatggtgcagctggagaatggtgactggtggttcatcattatgcaagaccgcggtcccattgggcgtgtgcctcatttgttgccggtgaagtggattgatggatggccgatgctagggacagaagggaaagatgtaattacctatcagaaaccggaagtaggaaagaaacaacaacgactgacggctccggctacttcggatgaattcactgggaagaagctgggcctgcaatggcagtggaaccataatccggataatgcgaattggtcgcttactgagcgcaaaggttatatgcgcttaaaagcgttgccggcagataacttgaaagtggctcgtaatacgttgacacaacgggtacagggaccatcgtcggaaggttcggtggagcttgatttgacaggcttgaaagatggcaatgtggccggattgggtattttccagttgccatacgcttacgtggctgttgtacaagagggaatgcaacgtaaaattgtcatgagtaatcaggataaagtggtagagtcggtcgatttgaatcaagcagataaaattcgatttcgtgcacgggtgatggataaggattttacggctcgtttttattacagcctggacgggaaaacttattatccgattggtgacgaattgaaaatggggttaggtttcccttggacaggaaaccgctttgcgttgtttaactttacgacgaaagagggcggacaaggaggatatgccgattttaactggttccattttactaataaatagaaactctatatggtattagtaaataatattttagactatgggaaaaatagttctcaatggataatttatgaattaaaataataataatgaagaagaatttagtatcattggctgcaatggccttattgttgtctgcttgcggaacgggagaatcccgttcattcaaaacagaccgtttcggtatcgatgtggataaccggggatatatcaccggtatgtggaacttgacacgcgaaagtcgtaatttcagtccggcggaccaaccgtcgcccctgttgtctctttatgacgaagacctgaaatgttattattatccgcagaaggctcattacagcggaggcaagtatcggttggaatacgagaacggctctgtggcaacggttgctttggatgagaagacaaaatacttcaaactgaagttggaaagtctggaacctcgtaatggaatcgacggtatacagtggggtaattactatacgaatattaccaatttgctaggtgaaatgattggagtggcgcgtgatacgtcggcggcagtaggttatgccatcggcgcattggcattggacgataatacgattggaggagaatcgcgttatacttccgaaacaggtccttcggggtatatcgcccacacgcctgatcctgtaaatcatccactgccgcttaccttgcatgaggggcaacagtttacgatggggggcgatggtatcaatgatgtggctttttataaccggaaggaaccgtacttccgtattttatatgggacaacggcttttgtcgattgcaacggacgaatcaatatccggtatcattcgcgtgaccgccggaaaggtaagatgatctattctccggagggtaatcctatcttccaaaacaatgaacctaaccacatgatgcgtcaggatgtgcccggagtggacttcatcggctcgtccatcgctttgtggggtagccccgacagtacggctttgatggaagttattcaggatatcgtgttgaatgaaggattgccttatcctactttccagggtaagtgggtaaaagatcctactaacttcatgccggatatatgtacctacggcggactgatggatagtgtcgcttcgtatgccaaacagatgggattgaaagtgattcatacgtacgaccagcctttcttgcatgccgatagggggaatggcggtttcatcgacggaccgaaccatgaaaagaaacggtatcattttacggacaaggatttgtcaacccgtgagtatgccgatcttttggcgaaggatggtttgattctgggacgtacctccatatccaactccatggcacctggtaccaaggattgcagcccggtcccatcggacagtatctgtatcttgcatcgtcgtttcttgacggccgacttgaatgaaactgacacgctggtttatatcgatgatccgactcatctggaagagatcgcttgttgggaggggaatagtaaggaattgaacatggtgaagatcggtaaggagttgattcactatttaggcgtaaccaaagagaaaccgtatcgcttgatgaaagtgacacgcggttattggggaactgaggctgtagcccatgccaaaggcaatgctgtagataaacttcaaccggctgtgggaggagcatacgcaggattgatcccgaacctggaattgcaggacgagttggcgcgtcattatgctgatatatgcaagaatagcggacttggtatgttcgattacgatggacaagagttttatttccatacaggattcggctcttattccgtgaaacgtttcttccggaatatgtttgcacaagcaaaagattatggtttgccggatatccgttttacgggagcaaccctgtcggaaggttcctggcattaccagagtatttggaatgtgggaggtggtttgaatatttatgatgtaaagaaacgtgtatggggtagtacgaccagccaggggaaagacctgcgcgatgttacttatgccaacttcttcccgtcgtcatttggaggtaatttccctatcacggagaaatctactgtagaagattttgaacatatcgaggctacggctgtcggttatggttgtacatacgcgttcaagataggtcagaaagacgtggaaagttgtccgcaaaagtatgccatctttaacgtcatccgtacttgggaggaagctcgtcgtgccgacgctttccctacttacatcaaaaagatgttgcaaaacccggcactcagctggcgtttggaagaaaaggcagacaatagtggctggatactttatcaaatggagaatggcgagagagttcgttcttttgatttgagatcatctctgaggtaattgcgacgaagtcccagataattgaatttagctcccagctgatcgcgaatgactccgaggaaaattcattttccagagtacaatgattaaaaagggcttttagaagaggaaaaatcatctttttttcttctaaaagccttttttctacaatacttttacaactgacattttgttattgaaagatttgtatcttggctggtttttttattggtagccaggactttctgtttcggatgttgaaatgactattagttgcttataaaaacagtcgaaatgataatccttaacttttcaacagtgacctatttcggttcatgttcgatggtagatacgtagaggacaaagcaataggggaaagaatgacaaaagatattttgacaaaggtagtatggagattggatgtttatctcatttgtgttttttaactctttggtctaaatgttttaggtacaagaagtgtctttaatataaacgagtagtaatagttgatttaagtctaatctgaaaaatataaaagtctatgaatttgaaaaggatgacgatgggggcagcgttgatggctttgactctgttggcagaagcaaaagtgagacctatcgtacattataactttggaaagtcaggaaatgttacttacgccgtggcacccgagaaattaacgccgttggccggaaaaggcgaactggttgctgttggtcgccctgtcttctatgccgatgcgcccggtgacaaaaagatgaaaggagaaggtggtattttgtttaacggtaatggcgacggatataaactggcagaagctgtaggttttccgactgacaatcaggtattggaaatatgggtgaagccccgactgaatacgcaggaagaagagcaggaacaggtcttgttatccaatggtacaaccaaggaaggatacgtatttacgcatcagaaaggtcattggtttctaatctccggcggcacgggacgtgttgaaatcggcgaagtgtccaataacgcctggacgcatctcgctatggtagtggaagatggaaaaggctctgtctggatgaacgggaaaaagaccgggacattcaagccgaccaaagccgtggctcctcatttctccattgccgtttcggaagagggaaaagaggccttttacggtgaaatatatgaagtaagatacagtacattcgccaccggaaagtttaatcccgaatctgatttcctgctggattataaaaagataaaagagacaagcaaacaacgcttggccgaacgccgtaccttggtgcaacaactggaacaggcgagtgcgggcaagaagattgttacagagctccccgatgttcgtcaggaaaaagactggctgatcagtcaggtagaagaaccggcctgtttgtatgtacagaaatcgaaagatgggttgacatccaacctacagttgaataacgggttagtttcacgtaccttttatgtcggtgagaatattgcctgtgtaggatataagaatcattcgaatgaggctgaattcttacgggcggtgaagccggaagcacgtgtttgcattgacagtgtatggtatgaagtcggcggattgaaagggcagccagaattgtcttatctattggatagttggtatacggaaatggaggcttccgacctggcgtttacactggagaaagtggaaaccggccttccgctgatgcgttatccatggacaccgaaatataatgccgttccggcagactggcctgccaagggattgcgcatggagatgactttcgtgccgactgaaagtatggtggaggtgaaagacatacaggtgaaagtaaactatgaaatctatcagggattgcctgtgattgccaaatggattgaggtgattaatgaaggagaaaaggaagtgctgctaaatgagatggagtgtgaagtgctggctgttaaccaggaccaggtgaagcgtctgcatgtggagagtgatttttcctttgcgttggtgaatgcggatatagagggtagtgcgttgatgcattacgccggtacccccaagccttatcatgtgggcagctctactaccaaatggacggttgacaaagactacaatacctgggccagtcataatcaggcggaggataagttccttggctttccgcatcataacttattactgagtaaattgccgatgggaccttatacgaaagtaagcaaagaggttcccttcaaatcatatatcaccttcgaattgttgcaggatagtgacgaccgcgaacgccagtcgctcggacatcgccggatgtataagaaactggctccgcagactactgagtcgttgatttctgctggcattacttcgcacgatgaaacaaagttgaaagcactgattgaccaggctgccgaactgggacttgaacaactggatattcaagcctggccgggtgtcagtcatgacaacctggattcggtttatgtgcagttgtggcgccgggtggcgacatacgctaaagagcgtggtattgtgatgggaggctacgagttgcaggttgcctctcgcgggcgaggtgccgaggtggattgcgttcatccggaaacaggaaaaccgggtagccttttcggtcagagcgtctgcattgccagtgagtggaaagatacatactattcgaaaatgtgggagtttttcgataagaccggatttatgacgtataatatggatggaccgtaccacggtgatccgtgtgcttcaactgttcatcctcaccatacgcggttggaagattcgcagtggcagcaatggaaaacgcaggtagaggttattcatgaactgcaacgccgaggtatgtatatccctattcccgactggtatttcctcaacgggcaaaactcaaccggaatgggataccgtgaagccagtgccaacctgactccgcaacagcagctcttgttaggccgtcagtatatctatgacggaacctggcataagattccgactatgggatggatgaccttacagctggtcggcttctatacgaacgatccgcgcgtaggcctggagcctctttgcgacaatttggatcgctatgaagcgcagttgatgcagttcttgggaagcggttgccatctgactattcgcggaaatcgcttgtatgatacgccggagacaaagcagatggtgtctcgttgcatcaactggtttaagaagtatcgcgacatattgacttctgatattatccacgtcagccgtccgaccggccgcgacctggattgcatgatgcacgtgaatcctttcatccgtcataaaggtatggtggttgtgtttaatccgactgacagggatatcactaaagagatgcgtttgcctctgtattatacgggcttgaaaggcaaggctacggtcacctcttcagacggaagcaaacagaacttctctttgaaccgggaaggtgaattactgctgccggtttcgataaaggcgcagggtgtgtcctggttcctgatagaagaataaagtataggttgattgaatgaaatagggagatagatatgaaaaagttgttatggttactgattggcggatgcgtttgcggtctgttggctacaggatgtaaggatgccgcagattcgaataaccgctatgtaaataaatggattggtacggcttgggagggcagggtgtctcctgtcgcctccgtaccgttcggcatgatgcagattggtgcggatacgcgtccttatggtgcaggctatcattatgacgatccgactgttttaggatttagtcatctgcataaaagcggaggcggatgtgccgacttcctggacatcttgtttatgccgttacccttgaatcagccgacaggcgaggatgaattgtactctaaacaataccaggcggctttgtcgcatcaggaagaaaaggcggaaccgggctattattcggttaaattgtatgataggcaattgacggtagagttgaccgcttcccgccggtgtgggatacaacgctacaagtatgcatccctaggagaaatgccggtaattgtcgatttgaagtatggttctgaaagtgcttgtaccatacaagccgagcacgatgtggatacggtatatgcctctgcgtttgagaaggtcgacccgtacacgattcgcggctatcgtttttcaaatggctggacaccgaaacaacaggtctatttctattctaccttctcttcacccatcaaaacgtgtgccttgtatgtagacgaccggcgcgtcgaggagaccgctgctgccgagggacgcaatgtcaaggcgctacttacctttgaagatggacagggggaactggtagtcagaacggcactctcatcggtgagcatggaaggggctgccgccaatttgttgtcggaaacgaaaggaaagacatttgaggatatcagggaatcggctttcgatgtttggagccgtacgttgggacaaatcgaggtagagaccgacgacccgaagaagaaagagcttttttatacctctttacacaatgtcatgctgtatccgttcctgttgtcggacgtggacaatcgtttcagagggccggactggcaggtgcatcaaaccgatggttttgattattacggaggtgtggtcggtttttgggatacgttccgggcggcttgtcctttattggcgatgttgaatccggtagtggcgaatgattatataaagacgttgctggagcattacaaatatgccggacagttgccgatatggacgttgtggggcattgagaactatcagatgacaggtattcattcgttgccggtgatagcgaacgcctatctgaatggcatccgtggtttcgatgccaggttggcgctggaggctatggtggcatcggctatgaaagatacgtgcggctcttccatgggctattttgtcggattggagaactataagaaatatggatatgttccttgcgatatggagatggagtcggtagcgcgtacgctggagtatgcgttcgatgattatgcactggctcgtttagctgaagcgattggtgcacaaaaggaggccgcttactttgcaaatcgttcgctcaactatcggaatgtgatcgacccgaccaccttgttggcgcgagggcggctgaaggatggcagttggcgtacgcctttcgacccgttggcctcttctcatcgcagggatgattattgtgagggcaatggttggcagtggactttctttgtccctcacgatgtggaaggactggccggtttgttgggaggcaatgagtcattggaggcacgactggatacgcttttcggcatgtcttccgaattgcgcggagagaatgtctccggtgatattaccggactgatcgggcagtatgcacatggcaatgaaccggggcatcataccgtttatatgtataaccgggtaggccgtccagacaagacgcaaaagtatgtcaatcaggtattgacaactctctataataatactccggatggtatttgtggtaatgaagatacgggacagatgagtgcctggtatgtctttagttcgttaggcttctatccgatgaacccggcttccgggcaatatgaactgggtgcccctttgtttcagaaggcaacaattaagctctcttcggggaaaagctttgttatcaaggctaacaacttgtcggaaaagaatatttacgtagacaaggtttttctgaacggacagcttctgaatcgaacgtatattacgtttgacgaggtgctgcagggcggcgagcttctctttgaaatgaagggtgaggtaccggttatttgatttatgtagcaataataagcaataataatccacgaaataggcagctatttgctattttaaatggggatagctgcctttatatttgcgtcattaaataaatgtgatactaattaatatttgaaccatgaaaaagatactatgctttatctcgatgttctgtttgtgcggaaatatgttgtcagccagagaatatcatgtgtcggttaaaggaagtgatgccaataatggtgatgcttcatcccctttcaaaacaattaaccgggctgctcagaaggctttgccgggagatacggttacggttcataacggaacttatcgtgaatgggtgaatccactgagcggcggggaacgggaaggtaaacgtatcctgtatcgggtagccgatggtgaaaaggctgaaatcaaaggctcggaattagtaacgggctggaaaaaagagaagaaaggcaaaggcgtatggaaggttgttttgccgaatacattctttggaaattataatccgttcaacgaccgtctgtatggcgactggctctggtcagagcgggttcaccatacgggagatgtttatctgaatgatgtttcactgtatgaagaattttgtttggataaggtgttcgcaccggatacacttcgtacgatccgtgatccgcaaggatgtacgaatgtttggtttgcagaggtggacgctgacaatacaactatttatgcaaactttggaaacgtcgatccgaataaggaaacagtagaggtttcagttcgccctacctgcttctatccgactcgtgaaggactgaattacatcacaattcgtggcttccatatcagccaggcagctacgcaatgggctgccccgacggctgaacaggtcggtatggtcgctcctcattggagtaaaggttggattattgaagacaatgtcatcaaaaactcccgtagcaacggtattaccttaggaaaagaacgtgccagtgggcataacctggagtgcaacgatccacgtttggatggcacattgcattatatcgaagtcatatttaatacgctacgccgtggttggagcaaggataatgtcggctcacatatcgttcggaataatattatttccgattgcgaacagaccggtatttgtggtagtatgggagctgcgttcagtgaaatatatggaaatcatatttataatatcttagtgaagcagcaatttggcggcgcagaaatggcaggtatcaaattgcatggtgcgatagatacttatattcatcataatcggatccataaatccggtaattatgggatttggttggactggatggctcagggagcccgggtatcatccaatttgctatatgataatctggctcaggatttgttctttgaagtttctcacggtccttacatagtagataataacatctctttatcgccacgcacaatacaggaaaatactgatggaggcgcgtacctgcataatattttctcaggagatatcaatcgtttggacgatcaacgctatactccgtatcatttgaatcattcaactgaggtgaaaggtatccggactattactgaaggcgaccatcgcttctataataatatctttatcggaggggagaacagtaagttgagatatggtatggtggtgttcgatgtatctcaacggccgatctatgcagacaacaatctgtttcttaacggagccctgcctatgacgaataaaacgcaggattgggtagaaaaggctgtcgatccgaaactaaaagtggaagaaacggcagatggagaagtgtatctcgttagtgacattaatctgcaagaactatcttctttcaaagggaaaggaattgatgccgaccgccttggtattacccagttgaccggatttccgtttgagaactttgacggtactcctttctgcttggagaaagactatttcggtaaggaacgttctacgtccccggttgtgggaccggtagaaagtttaccttcttccaatcgtataaaagtgtggcctaacttaaaataacagtcaatgtcatataagaatcatttatttctggtgggcagcctgcttatgggagggctgcttacctgttgtcagtttgatgcgaaacaggtatcggatgataatatcatccccgtttcaacaaaccgaatgcttaaccctatcgcccctccgggggtatatattgctgatccggaggtaagacagatgcccgatggacgtgtctatgtctacggatcgcgtgatgaacctggtaacgcctggtgttcgcgttcctataacgtgctttcttcgtccgaccttgtgaactggagtgtggaacaattttcatttgctactgaaggaccgggtaaacaagtggattataccgacaggatcttatacgctccggattgtattcatcatggcgggaaatattatctgtattattgtttggccggagggggtgatgatgaaggtgtggctgtttcctcttctccttacggtccgtttaaggatggaaaagtgatagagggcataaaaggtatcgacccgtccgtgttcatagacgatgacggacaagcctacctgttttgggggcaggggtatgccaaaggggcgaagttgagtaaagatatgctttcgatagaaggagccgtacacgatagcttgctgacgtatgaaacacatttcttcaacgaaggcagttctgtccgaaaaagaaatggtatttattattttgtgtatggaagtcattcgcagcatggagaatccaactgtgcgacgttggattatgcgacatcaacttctccgttaggtccttatacttatagaggtgttatcgttgataattggggcagtggccggaatttggtaaataaccatggctgtattactgaaatcaacggtcggtggtatattgcttatcatcgccctactcatgcaagtgcgaccatgcgaaaggcttgtctggagccaatctctttcaatccggacgggacgatcccaaaagtggaaatgactacgcagggaattggcggacctatctctcctttataccggatggatgctgccagggcttgtctgatgtctggtaatgtaatggtatccgtacgtcgtccggagaatgatattcctgtcgagtatttggctgctgttcgcgatggcgatcatgcttattggaaatattatgattttaccggttcggatgtcaatcatttcatatgtaagacctggggtaaaaacaaagcagctaagatcgaaattcacctggatagtccggagggcgaactgatcggaaccagcgagttagctccgatgcagggtgagacggcgtatgctattcatgaaacgaaaatcaaaccggtgacagggaaacatgcactggtcttggtctttaaagcggttgatccgaatacaaaggatgttgatttaatgaatctggaatggttcgtttttgagaagaagtaatataaatttatacttatatatgaaacgaattctactatttattgtactggcattatttatatcccggtcaaacgcacagattgctgcgatagatgttgataaaggttctgaaaagacgccggtagaggatatcataatcgtatttaaaatgcattttgatatcggatacacggactgggcggaatcaatccttcagaaatatactacttctatgatggatgagacactgcattctgtaaatgtaacaaataaattaccacgggaagagcagtttgtatggactcttcccggttggcctatgaaatatattctggaaaatgtatcggcagactgtaagccgggtattgaggctgccttaaaagagggtcgtttcagggtacatgcgcttccttttacctttgagacagaatcgagcgatctggaaacgcttgtacgcggaatgtcatattcttccaatatcaaccggacgtatggacatccgctgacaagaggggcaaaactgactgacgttcccagtcattcctggattttaccaacactgctgacacaggcaggagtaaagattttacatatcggatgtaatccggggtcagtttctccggaacttccgacattgttctggtgggaaggtcctgacggctcccggttactgacgtttaactgggctgaatattatggatcaggtgttttgccgcctgaagggtggaaacataaaacatggttagccatgatccatacacatgaaaataccggagctccgaaaccggaagaggttgcggctgtattggaagaagcccgtaagaaagtgcccggagccagggtcaggataggacaactggaagatttttacgatacattgatgaaagaaaatccatctattcctgtggtacgcggagatatgcccgacacctggattcatggttatatgtcgatgcccaaagaggtgaagatcaacaaatcgatgcaacgtctgatctataatgaagagaccttgaacacgttgctgaaaggctggaacgtaaaagctgaacctgtgaaaccgtatgtcgacaaggctgttgaacagtcggtattatttgacgaacatactttcggactggcaatcagccacggtcaccaggctttctggaaatatggcgatccgtttgtaatagatcgtgcgaaaggtgcttatgattttattgaagaatcatggaatgaaaaggctaaccgggtacatcggtcgaaacaatatcttatcccctctttgcgtaaagacatgcgtaatctggccaatgccgtagaaggggatgggcagaaggtggtggtatataacccgttaccctggaaacgttcgggtgtcgtttccttgtttatggatgtgtatcagaagaaatttactgtttatggattgaaagacgaacagaccggtgaggtcattcctgtttacattgagggtaactatctctcatttaccgctcgtgatgtacctactttgggatataaaacatattcggtgataactgaacctgtttcggaaaaggctcataccattcgtgtcgatcaggcagaaaatgttattgagaatccctatttcaaagtcgttatttcaccggaaaacggtgccctgttgtctgtttgggataagaaacggcaacaggagatggtcgataccggcaatgaatacagctttggtgagtttattcatgagaaatttggtaatgaagagatcgaacgatataacaaggcatacgttaaaccgggtcatcacggttgggcagatcctgagatgggacgtccggtcgatccggctttaaagtatgaaaagataaaaggtagagctttacggattatttataatcaaacagtacactcagtggaagccacagccttctgccgtaccagccgtggtgaagattataccttgacctatacgctttatgaagattctccttacctggaaatctgttgggggatgcagaacaagcgagccgatatgcaaccggaaggcggatggctggcatttccattcaatgtctctcagccgactttccatttaggacgtacgggggctgttgttaatccggctacggattttataaagcggtctaatcatgattattattttctgaatacggggatggctgttgtcgacccgaaaggaaagggattcggattgaatactccgaatgctccggcagtcagcctggatcgcccggggttgtatcgttttaccggtgactttattcctcaaagagcgaatgtgtttgtcaatctgttcaatacccagtggggaacaaactttacagagtgggtggaaggtgccctgtcggcgaaggtctatttatggtcggtcgatgaatataaaaatgagccttcactgattactccgacagaagaaacacgtgtgcctcttatggctgtttaccgggaagggaaaggtggcgaactgcctgtgtcggcagaaggaatacagttgtcgaagaaaggagttctggttacagccttcggggccaatacggacggagacggagaagtcctacgtgtctgggaacaggcaggggatgcgggtgaatgtgtgatcacattacctgattgcggttatcgtacggctcagtattgtaatttgcgtggagaacgtcagggaaaatcctttcctgtaaaacaaaataaaatagctattaacttgaaggcttaccagccgttatcattaattctggagaaataagcaaatgaaattcaataagtgtgtttttatatgtattagtctttttgtatgctctgcttttatgcagaacttgtcggcagaaccttccgggaggaaggttcatgctgataagaaaattccgcagctttcagagaaagaaagctggttaccggtagtgaaggatataactaaaaatatccgtttgctggagtgttcttacaatgaagccgagttaaagcattgtgaagagatcatttcgtcttctgcctgggaggtacggaccgaacagacaatggctaatggaggcaaactgtatactttttcttttacagccagacgggatatgaaagatgccggcgtggcagtggcattcgaccggtatggctggacaagtgataattatgtgatgatcccttcttccgtttataatggtaacaggcaacgtattgtcaaccgttcgtatgctacagggctcgataagacagattataaccggaaggatctggctctgacttccaatccgattccgcagctttctcctgagttcggagcttcctcccgtttggaggtcaatgtcagtaatgcggcgactccggccatgacgatgctggaacgggggaagaagtccggaacgattttactgaccgaccagggtatcgaatggaataagcaattattggatcatgccctgatcgttgaagaaacaccggatcgcagtattgcctcttttgtcatcagtgctccgggagtgcgggaacgtaaaccggaatttatcggtttcagtaaaagtcccgaccggggaatacaggtgaagaaaggagacaaaatcgttatacgggttaccgagatcacttttccctgtgaagatgttccggaattgctgacccgctttatgaaagatcgtaaactgcatactgccggggaagctccccgtaatctgatgccgatgagcgaagtactggcacgtatggtacggaatatcgatgatcgctattatgtgggtgaccagtgggaatattactgccccgagaatgccgactggatctcttacggctggattggcggtctgatgaatacctatccgatgctggctttaggcgatgaggagcatttacggaaagtgaaaaatacgttcgacttcggactgccgcgtgcaaaaggaaaaagcggttactattatgatgttctcggatcggacgggaaagtcttataccgtgatgcggcggtcaacaatccgggaatcggcctgacccgtaaaaacggcgatgtgctttactggatggtcaaacaatttatgttattgaaggaacaggggaaagccaatgccatcgataccggttgggaaacgaatgtgcgtctgttggcagatgcctttgtcaatacctggaaaaaagagggaacatggggtaattatctggatgtggaaacaggcgacgtagctgtatataatacgacgagcggagcaatggcagtggccggactggctctggcttccgaatattatactaatccttcttatctggaagtagcctgcgaagctgctgctgactattacgataattttgctttagtcggctttacctccggaggttgcggtgatatccttcaaaatgcagactccgaaacggcggttgctctgcttacttctttaatgacactttatgaagtgacagggaaagaacaatatctaaaacaatcagccgatctggcaaatctatgtgctacctggacagtctctttcccttaccgtctgccggaagataccccattggcaaaactgggggccaatctgactggtgccgtttgggcaagtacgcagaataagcatggagctccgggtttttgtacgcaatcaggagatgccttgttcaaattatatcgttctaccggcgatgtttcttatgcggaattactccgtgacgtgattcatgcccatgcagaaggcatacaacccaatggaaagattacagaacgtctgacttattgtgatgccgacagccgtggttctcgcggagacggcggcaagactggttggaacgaaacaaacggtgctatgatggcattggaaatcccgggtatttatgtgcggacagatctcggttccctttatgtatttgaccatgtagaagcgaaggtaatcaaacagaacaagaaacagttagtcctgcaaattacgaacccgactgcttacgatgctactgtcaccctttttgctgagaatgcagaagatgctgcccgtccgctgggcgacaatgccttcctcgggtggaaagataaagtgaccgtaaaggcaggtaagtccgtaaactataaactaaaaacaaattgataacaacccttatgacagaatataagaaagtcctttcattgtgtgccgcctctttgcttcttttcagttgtacgaccgaaaagacctgggatttcaatactgactatttcagtattggcgtgaatgacaagggatatataaccagtatgaaaaatacgacagtatcaccggcccgcgagttcagcccaactgacaaaccctctccgttgatgtcgttatacgattctgagaaaagggtgttttacacaccgcaaagtgccgttttcaatgacgcaactcagtgttttacgttggaatatccgaacggctctgtggccgaagtcgcattgcagcctaatagtaaatatttcaaactgacattaaacagcttagagccgagaaacggtatcgatgcgatccaatggggaagctattatacaaacatcaccaacctgttaggtgaaattatcggagttgcccgtgataccagcgatgtggtgaattacagtatcggtgtgctcgctctcgacgataatacattaggcggtacacccgatatcgaaggcgatgccgcccctttccagtacatcattcacacgcccgataaagaacgttaccccttaccggacagcctgcatgaaggacaggtgtttaccctgggagggaatggcatcagcgatgtggctttctacgccaataaggaaccttattaccggatcatgtacggaaatgcagctttggtggatagcctgggacgcatttacctgaattatcagtcgagggaccgtagtaaaccgcgccaggtcttttattccctgatcccgaacatgccggcaaatataccgaaccatatcgatgtggaacctataccgggtgtcgattttatcggctcttccgtcgctttatggggtagtccggacagcacggcgctgttggatgtcattcaacatattgtcctctcggaaggattgccttatccgaccgtaaaaggaaaatggatcaaggatccggcagcttttagtccggatgtaatgaccagcggtaaccgttacgacagcattatttcgtataccgcccggttaggtttccctgccatccatgcctacgaccagggatttttacgtcccgaccgtgccaacgaagggtatctggacggaaaagctcagacaaagaagcctttccgttttaactcaggaaataaatcacatcgtgaatttgccgatctggcggcatcacaaggattgatgctgggacgtgtctgcatcaccaactcgctggcaccgggaacaaaggatgccagccctgtccccagcgacagcctgtgttatcagcagaaacgcactttgatgaaaagtattacagcccaggatacgctgattgtggtcgatgatccgaaatacctggaagaaatagccagttgggaaggtcattgcaaagaattgaatattataaaaataggaaaggaattgatccattacctgggagtttccgaaacggctccttatacattgcaaaatgtaacccgtggatattggggtacgcaggccacgagtcatgaggctaatgaacctgcctataaattgcaggtgaccattaattacggttatgacggattgattccgaacctggcccttcaggataagattgccgaatattatgcagaggtggctgcccatagcggtctgaccctttatgatttcgacggacaggaattcctgttcaacaacggccatggttattattcagccaaacgtttcttccgtaaactatttgaaagggcaaaagaactggatgtcccttatatccgtttctccggtgccaccttgtcggaaggttcctggcattaccagagcgtctggaatgtgggcggcggacgtaacctgtatgatatcgatacccgcgagtggggaagtgcgaccagtcagggaaaagacctgcgcgatgtgacctattcgaattattatccggtttcattcggcggtaattttgcgatcaaagatacttctaccgtagaacaatatgaacatgtgcaggctatctcagtcggctacggtgcaacctatttcctggcaatcaaccaggaagatgtagaaagttgcccgcagaaagacgagatattcaaagcgatccgtacctgggaagatgcccgcagggcgaatgctttcccccggcagctgaagaaacttctcagggacccgtcctacgactggaggctggaggccggtgtagacggaaatacctggacgctgtaccgccttgtcaatggcgataaggtagaatcgtttgttttacgaagagcggaagggtattgaaagtatgcgagcttattgtatgtaggatgattacatatagatattgtttgtaagacagtatatgttgctgtttttcttgtatatctacttgctaatctgtatatttgttcccgtaaatacctggaaaactcaatctttatatgtgataaatacaagaagtatgaaaaagttattgctaaccttgctggctgtacctctttgggtaagttgccaggactctcaccagatcgaagctaaaatagcccagtctccgaaaacgttttgtaatccggttaacctcaattaccggtttatgaaaatagatggaggcgaggggattcgggaagctgccgatccggttgtagtaaccttcaaagagaaacattatctgtgtgcatccaagtcgtcaggttactggtattcggatgattttactaattggaaacatgtttttataaccgattccgtgctgcccatcgaggattatgcaccggggctttttatacacaatgactacctgtattatgtgggctccacgcatggaaaaggaatgttgtaccgttcatccgctccggaaaaaggagagtgggaaccggtgaaggaaatctggtctttctgggaccctgctttttatgtggaaggggataatttgtatatgtactatgggtgttcgcctgtcgaccctatctatatgcaggtactggacctgaatacattggaagcaaaaacagaagtgatcacttgttttaatagcgataaggaaaatcatggttgggaacggacaggggaactgaacgaacttccccgtcgtccttatatcgaaggagcctggatgacagcccatcaaggcaagtattatttacaatatgctgctccgggaaccgaatggaagtcgtatgcggatggtgcttatgtcagtgcatctcctaccggtccgtttacctatatggaaaacagtccggtttcgtataaaccgaccggatttatcggtggtgccggacatggctgtatgtttacggtcggtaacgaaaactattggaaagcggcaaccaactcgatctctgtccgtcatatgtttgaacggagggtttctttcttccctgccggtttcgataaggatggttacctgtatacgaatacttatttaggagattatccgatgtatctgcccggaggtaaagagcagacagccggaagttatcagcctggctggatgttgctttcctataagaaaccggtcacagtctcttcttcactggatggttatccggcagagaatacggtggatgaagattcccgcacggcatgggttgccgcatcgaataaagcagacgaatggctgcaggtcgatttacagaatctctcttccattcaggcaatacaggtgaatttcgacgaatacggagcgaaccagcgaggctttgttccggatgtttaccagagttatttgatctctgcttctgctaatggcaaagactggtatccggtggtagattacagcactaaaaagacagatactcctcatgactatatcgaattcgaggctccgtttaaggcacggtatatcaaattgcaaaataaagaatatacagtctcgtcgaatctttccgtccgtgatctgagaatcttcggtaacggcctgggtagtaagccgcgtgcagtgaatgactttacagtgaaacgggatcttaccgatccgtgtagggtacgtctgagttggaatgaagtgccgcatacccaagggtatattgttcgttatggtgtggcggaagataaactgtataacaatttccaggtaatgggagacactaccctggaaataggaagcttgaatcagggtgttacttattattttaccatagatacttataatgagaatggcgttactcaaacgtcgcaggtggaagtttgccaataatagcagaatagaaaacaaaagatcgaagaatgaaaagattgatttttacggtgatgttattgcttcccggcctttggatgggagctcagtcacagcgggaaaaagagttgttgaatcaagattggctttttgctaaaggacatgcggctaatccggaaaaggattttaattacggacaggcactgtcgttttcaaaggtggcttttctgcaggaatcgaccttattgaatgcagaccaggagtcgcgtctgtctattcctcatacacagaagtttgatgacagtacgtgggagaagatctctttgccacatgactggggaatggcattggattacagcaaggaacagtttaaggtgaaaggatatcgtaaactgggtggacgttcgcccgaaaatagtgtgggctggtaccggaaacggttcactcccgaactggtgaaaggagaccgttatacgctggagtttgaaggtatattccgtgatgcccaggtgtggatgaacggcatttatctgggacgtggtgaaagcggttatgtccctttggtattcgatgtgactgaatgcctgaattatgaaccggatgcagaaaatgtgatatccgtacgtgtagatgcaacccattctgaattatggtcgtacgaaggtgccggtatctaccggaatgtatggttgacccgtacggctcccgtgcatatcccgcaatggggaacatttgtcaccagcgaagtggatctgcagaagaaagaagcccgtgtgaaggctcagatagaagttactaatcagagtggaaatacatcgaatgtcattgtaaggaatactatagtagacaatcagggtaaagagatagccagtgcagatgcacaggtttccgtgaaatcattggagacggaagaagtcgggacatttatgaatgtaccggatgcccgtttatggtcattgaagactccgactctttatacattgcatacagatattgttgcagatggaaaagtcgtagacagttacgatacctctttcggaatccggagcatccgtttcgatgccaacgaaggtttcttcctcaatggcgaacgtgtccagatccagggcgtatgttgccatcaggaccatgccggcgtaggtattgcagttccggatcagctgaatgcgtggcgaatcgcccgtctgaaagaatatggagtgaatgcatatcgtgcatcccataaccctccgacaacggctgtgttgaatgcctgtgatacactgggtatgctggtcatggatgaaatgcgtgtattgagttccagtgatgaaggattgaatcagatgaagactgtgattcgtcgcgaccgtaaccatccgtccattatcatttggtgtcttggaaacgaagaacctgcgatacaaggtacggaaaaggggcgtatgatcgttgagcgcatgaaagccgtccagcgcaaactggacccttcccgtccgtgtacggcggcgatgaacggtagctggggggaaggtttcacctatgctgtcgatgtacaaggatcaaactattataagataggtaatatcgacgcagtgcatgagaaatttccgaacctgccttgtatcttcacagaagaggcaagcacggttatgacacgcggtatctatgaaacgaatgccgccaaaggtttccatcaggcttacgaccgcgatcatccgggatggggtgcccgtgcgcaggaatggatgcgttatgtagatgcacgtaaatttgtggccggtgcctttgtctggaccggtttcgattacgggggcgagtcggtagcacattactggccgggcgtggtgtctcatttcggtattctggattattgcggtttcccgaaagatgctttctggtattataaagcctggtggaccgaagaaccggtgttgcacgtgcttcctcattggaatggaatcggaaccgattcggtcgatgtacatctgtataccaatttggatgaggtggaactgttcctcaacggtaaaagcctgggtaaaaagactgttgagaagttcgatattcctgcctggcgtgttaaatatgcttcgggtaagctgttggctaaaggaaagaaggacggaaagaaatatacagagttggtagaaactaccggaaagccggcttccctgcaactggtcagtgaaaatggctcagctatccagggggacggcaatgacgtggcaattatcaccgtaaaagtcttggatgccaaaggtcgtgtagtgccgactgccgaaaatggaattcatttcgatgtccgtaacggcaagatcctgggagtgggtaacggtcatccttccagccacgagccggatgttttccccgcaggcagcgatgtacataggaatgctttcggaggatacgcccaggtacttgtttccagtgaccgttcaggacaaccaattgaactgactgccgtatcggaaggactgaaagagagcaaaatcattgtcgaagtaacaaaataaaatagataatctcatgaaaaataaactgaaaagtatcgttttactggccgttgtctatttgaacggtttggtagcacagacgtatgagtatccgttccggaatccggatcttccattggatgtacgtgtacaggatattatttcccgtctcactctggaagaaaaagttcagttgatgaaacacgctgctccggcgattccccgcttaggtataccggcttataactggtggaatgaagcgcttcatggcgtagcccgtacaaaggaaaaggtgactgttttcccgcaggcgatcggtatggctgccaccttcgacacggaggctttgcaactgatgggggatatgacctcttcggaaggccgtgccctctttaacgaagatttgaaagcaggaaagaccggaagtatttaccgtggacttacctattggactccgaatatcaatatcttccgtgatccccgctggggacgtggtcaggagtgttacggcgaagatccttatctgacaggtaagatgggaacggctattgtccgtggtttggaaggtagtgattctcactatctgaaagcagtagcttgtgccaagcactatgccgtacatagcgggccggaaggtaatcggcactattttgatgcacgaacctctttgtatgatttatgggatacttatctgccggctttccgcgaactggtgatgaaagcgaaagtacatggggtgatgtgtgcttacaatcggctggaaggacaaccttgctgtggccacaatgagttgttacaggatattcttcgtaaccagtggaaatttgatggttatgtgacttccgactgttgggctgtaaaggattttgctcatcatcataaaacgcatagcaatgatatagatgctgtagcagatgctgtactgaaaggaactgatctggagtgtggtgatttgtatcagaaacttcagcaaggtgttcagcaaggcattatttcggagaaagatattaatgtctctttggctcgtcttttcaaaatacagtttaagttgggtatgtatgatccggctgaccgcgtaccgtatgctacgatcgggcgtgaagtgatcgaatgcgatgcgcataaggcacatgcttacaagatggcgcaggagtcgatggtcttattgaagaataataagaatatacttccactgaacgcgtctaagattaaacgaattgctttaatcggtccgaatatggataatggcagtacactgctggccaattatttcggtgttccaagtgaaatcataaccccgtacaagagtttgaagaaacgttttggtaatacgattcagatcgatacgctgacaggtgtcggtattgttcagaaactggaaggtgccccctcttttgcccaggtggctgctcaggctaagaaagcagacattatcatctttgttggcggtatcagtgctgactatgaaggagaggcgggtgatgccggagcagccggttacggtggttttgccagcggtgaccgtacaacgatgaagttgccttctgttcagacagaactgatgaaagagttgaagaagacgggccgtccgttgattctggtcaatatgtccggttccgttatgagcttcgactgggagagccgcaatgcagatgctatcctccaggcctggtatggcggacaagctgccggtgatgctatcaccgatgttcttttcggtgactataacccggctggccgtatgccgttgactacctatatgaatgatgaagatcttccggatttcgaagattattcgatggcgaaccgtacgtatcgttattttaaaggcgatgttcgttatccgttcggttatggcttgagctatactacattcgcttatcagccgttatcgaatgcttctgtcgtgaaaaccggcgaaagcatccaggtgacgacaacagtgaccaataccggtaaacgggatggtgatgaagtggttcagttgtatgtctcccatcctcagaacggaaatacccgtgtcccgctacgtgccttgaaaggcttcaaacgtattcatctgaataaaggcgaaagtcagacagttacttttacgctttccccggaagagttggcattagtagatgacaaaggaaatctggttcagaaagaaggtccggtagaattatatatcggcggaggccagccttataaatcggaaggaagtttcggtgagttgaagattgagggcgaacagtatgtcgtatattaaaaatataaatatagtagttagttttgctgttagcctgttgctgatcggatgcgatcgtcaacaggctaatgccttacaggagtagggtgagattgagattttgggcttgcgggtgtattggctaattttcatatctgttttctgccagttcctgcaagctctttctttgttatatcttggaagtatgttatatttgtcctttgaagaaactgtactaccatgattattaatgaaaaaacattcgaagaagtatataatgactattttgaaattatctgccgcttcttgaattactatacccacgattatcaggaaatagagggggtagtacaggatgtttttgtcagtttgtgggagaactatgaaggaaaagaaatagcatacatcaagacctttttatataacagtgcccgtaatcggatgctgaactatctgcgtgacgaagataatcatgctgccatattggaaaagtgggcccgcatcgaattagagaaaaatgagtcggtcgattgtatagatcgtgagttattctatcaattgctacaggctgccgttgaatctctgccggaaaaatgtagggaaatctttatcctgggccgggaagaacggttaagctacaaagaaatagcacaagtaaaagaaatatctgttaaaacagttgagaatcagatggggattgctttaaagaagatacgggaatacataacatcccgtgccaatgagtcgatgctatctattctgctttccctgaatctgtttgagtaatcacagataataatgttgactaataaagaaaatgaaagatgaaaacaatacgaagtatatggtctttaattttgattctgctcatacaactgccagtcgaagcggtggctgttgctgatgagaaaaaggattcgctcttttttgaatcgaaaaaggaattgatgactgctttttgggaggaaccattcagctggaacgcaattcgtagtaaccatgctcctttaggtccttatatggggaacggagatgtgggagtggttgcttttacatccgataacagccagacgttgaaaatatccaaggttgatttcgtcactgacggtttttctaattgggcggggagcggcccttcagcattgccggtcggtggtgttacgctgaccgttcattcaccggttcatgccgggaattattcgatcaaccgcccggataagactgtctttcgttatgaaatggatcagttgaatgctgaattacgtatgaagacggctaccgaccaaccgatcactatgacttcctggatgggaatgaatgaaaactttataataacagagctttctaccacttcggagaaaccagtcagtgtatctgtcgatacatacgcagatagtcgctttgcgtactataaaacaacttcttcggtcgttggccctatcgcccaagttactcggcaaacaaagaccacggagacaagatggatttgctgtgccggaatttcgactaagatagtaggaactgaagcgcgtctgttacaaatttctgatgccatggtcaggattgactttaaagtctctgccgagaatcctgtttgggtgataacctttgtatccggtggaggaaaaggtaatgccccgagattaaaagaggctgcaagccggttggcagcggtggatgaagcagatgtaaaccgtatcaaagtggataagattgcctggtggaaagatatgtggacacgttcgtatgtggagacgaatgacagtctgctcaatcggcaatacttatcttctatctatctgctggcttccgcatataatcgtcgttcacccgtgtctggtggtatgtatggtgtctggaacatggacgacgagatgatgtatcatggcgacatccatttaaattacaacagccagggaggtttttatagtgccttttctgccaaccggccagagatagctttgcctttctataaatcacttgaattattgatacccgaaggaaagcgccgtgctagagaggaggcaggcaaggtgcataagtcgttggaagggaagtcgtatcgaggcatattattcccggtaggagcattgggtatcggtgagttttataattattactggcagcaaaccatggatgcccctttcaatgtccctttgttcagctggtattacgaatatacgggagataaggactttctgcgcgaccatgcctatccgtatatccgcctctgtgcagatttctacgaagattatctggtgaaagaaccttatggcgattcttatcgctactccataacaaccggagcgcatgaaaactcctgggatgtgaacccttcttccgatctggctttcgtggaacagacgttcagcctgttgctcaaatatagtgacttgttgggcgtagacaagccaaggaggaagaaatggcaagacatccttaaccatctgcccacttataaagtaatacaaccgactaaagaacccaatgagggattacctgtctttgccaagaatgaagatggatgggacttgcctaaccatgtcatacagatgcaccctgtttatccttgcgaggtcttgaacctgcgttccgactcatcggctcttcagattgcacgcaatactttatattactatgaagtatcacaaaaagggtttaccgaatcgatgaatgcattgggactgagtgcatacgtgatgtgggcaaggcttggaatggatccgaatctcttgattaacagtatgaaaaagttgattgaaggcaccggacgaaactttttgattgtagatggtcatcattgcgcggagaagactaccgtggtggagacaatcaactccatgatgctccagtcagttgacaatatactctacttgttcccctgctggacgaaccagccggcctccttcacccgcttgcgggcgaaaggggcctttgttgtctctgccgactatgacggttcgaccgtcactgacctggaagtacatagtgaacgaggtggtaaatgccaattgtatgcccctgctttaggagaaaagatagaggtcgtatgcagcggcaaaccggtatcggtaaagagaaaaggaaatgtattctcgtttgctacccaggctggagaaacctataaagttattcatccctctaaataagtttttcaacacacacgttttaggctttagctgtatgtattgaaatacaattgatgcaatcggctgaaggctgaaaggtgtgtgttgaaaattttctgcagaaaggtgcagtaaaaaatatttcaaattcctttgggggtattaaggggcattatgtgtcaactaataaaagaaacggaaaatgaacgaacgacaaataccatataaactactagccaagtatttatcccggcaatgcacacaggcagaactggaagagataaatcgttggttgaacgaagatgccgaacatcctcttctgctggaaaagctgaagaggcaatgggaagcagttcgggtggatgactctgcctttgtgataccggataaagcagcggtatggaataaggtacaggcacgtatccgcgataaggcaaagcagattccgatgtattcccgttcattgttgatacgtgtttcatcggttgcggctgttattgctttagttttgggtttttcactctcttttttattgaatgatcagaaagaatcctggcaggcttctcagttcgaaaatgtagttatggcacctcccggacagaaaactcagcttgttcttcctgatggtacactggtctggctgaattccggatcacgtttgtcttataactatcagtatagtacacaagatcgtattgtcaatctggaaggagaggctttctttgatgttcaaaaagatacgcaatatccttttatagtcaagaccggtgccgttgatgtaaaagtacatggtacggcatttaatgtcagtgcttatgccgacgaagaagatataatggtggctttgcttcgaggtaaagtaagtttactttcggctgacagccaacaattactgacgtatctgtctccagatcagatcgcaatggtgtcgaaaaacaacttatcctgtcaggtgactccctgtgatgcagaggttgaatccagctggcatcataatttgttgaagtttgatggtacaccggcaaaagaggtatggaagaaattagaacgttggtatggagtggatattacattgtcgaatgtgtctccctttcaagtttattggtttaccattaagacggagtcattgacggaactattgaagatgattaataagatcactccgattgagtataaattagacggaaaggaggtgacgatcaaatataagtagacttttttcaaatgcaacgcgtctagccttatgcgtaaaaggcacagagacccctaatctccatgccttttgaagtatatatacttgtaggtttactaagctcatatgagcttagtaaaaagtgatatataatggcaaagatatagatatttatttataatcttaaagctatactcatgtttaagttaaattggaaattatttccggtattagctgcatttggtgtatataatattgcgtatgcacaagcagaaaagctggatttggctgtaaggaacagaacgttaaaacagttcattacacaaatagagaaagaaacggattatacttttatgttggaccaaacggttgaccagaatcaaaagatcacaattgatagccagcaggagagtttggaagatattttggcgaaggcttttgccggaaaacaaattagttacgaaattgttggtaaacagattattttgaaattaccacatactacccaaacgaatcaaataaagaagattactggagtaatcaaggaccaaaatggggaacctgttatcggagcaaatgtgtctgtaaaaggtacagctataggcacgattacagatcttgatggaaactttatgctggaagtaccggaggatgcaataatttctgtttcttatataggttatgtatctcaggaagttaaagttggtaataaaactttgttgaatatatctttaaaagaagatttacaaacgttggatgagattgtagttgttggatacggaacacagaaaaaggtaaatttgacaggagctgttacagctgtttccggggaagaaatgacaaaacgtccagtgacgaatacttcaactatgctgcaaggacaaattcccggattgcgtgtcgttcaaggtacaggacaacctggtgatgaaaatgtttcattccgtatacgtggcgtgggtactttttctggagctgggtcgaacccgttggttttggtaaatggtgtccctggtgatatgagtgctttggatccaagtatgattgaaagtgtatctgtattgaaagatgctgcttcttgtgctatttatggtgctagggctgcaaatggggtaattcttattacaactaagcagggagcaacgaatggtgataaagtttctatatcgtatagtggaaattttgcggtacatacacctacgaaaatgtttgatttggtaaccaattctgctgattatatgactttgttcaatattgcaaaaacgaattctggggaaggaggtctttatccggaagaagaaattgagaaatatcgaaattccaatggttctgttgagtatcctagctttgattggttagattatacttttaatccggcatttgttcatcagcataatttgagtttggcaggcacagctaataaaacgacttataatgtcgctttaaattttgtggatcaggatggtaccatgaaagaatctaattacaaaaagtataatgtgacggctgatttggctactcaagcaacagattggatgcgggtcggtttctttacaaatttgatgaaaggtgatcgtgtttattatgggcatggtcaagatgatgctattttatcagctatgtcgcaggctccgacgtatatgccttggcttccagatgacggaaccggtattaggaggtatacaaaaaaagcttatgataatgaggtgatgaataaaaatatggcaatgatttttgaagaagggcttcatcgtcatacggatatcaatacggatgtaaatacacaattatggttggatattaatttggcaaaggggttgacttggtatactaaaggcgctgtaagacagattaataccagaagtgaatattggagaggtaatccacagccggtttataattatcatacaggagtgatggcagaaatgcaaggaggatatggatattctgttgatgaaaataggacgttttatacgaatctgtatacttatttgaagtatgattttacaacacctaacaaaaatcataatttttcattgatggcaggttatagtatggagtctaataagtatgaaacattgcaggcttatcgaagagattatgattttgatttaccgactatcgatgcaggtgccggtgctccgaattggagtaattctggaaaagtggaagaatgggcattgatgtctggatttttccgtgtcaactataattataaggagcgttatttgtttgaagcaaatgctcgttatgatggttcttcccgcttgtcaccggaaggacgttggggattgttcccttctttttctggcgcttggcgtttgacagaagaatcatttataaaagatttgaatttatcatggttaaataatgcgaagttaagggcctcttggggtaagttgggaaatcaggaaataggattgtatccttatcaagctatgatttctaaggttaattcatatacgtttgataaaagtgcaatttcttcagcttatactcaaacggcttacgttaatcgggatatagaatgggaaacaacgacaattgctgatgtcggtgtagatttgtctttctttaatcggttgaatgtaactttcgattggtatagaaaagaaacagatggaattttgcgttctgctcaaatttctggtttgctgggaatgagcgcaccaactataaatgacggaaccatgttagataagggcatagaactatctgtagcatggagcgatcaaattgccagaggtctatttgacggtttgaattataatgtgggattctatgtggataggactcggaacacattaagtcattttggtgtgacggaaaaagacggtaaagtgattagggaagaaggtttaccgtataattcttattatatgttggattgcatcggtatttttgcaactcaagaggaaatagataaggccccgaaacaatatagtgatgatacacaacctggcgatttgcgttaccgagatgctaacaatgatggagttgttaatgatgatgacaggatgttgatttcgggtagatatccagcttttgaatatggttttaatgcaggtgccagttggaaaggttttgatatctctttgttgacacaaggtgtttctggattaaaaagttatatagatccaagatggggagaagctcctttttttcaaggatcagctccgacgaaagattatgtagagggaatgtggacggaagaaaatccatataatgcaaaatatcctagattgtactatcaaacattgggtgggggtaaaaatactcgtacgaatagttatttcttgagaagtacctcctattttcgtcttaaaaacttgacgatcggatatacgttgcctaaacaactgacagaaaaaatacgtatggaaaaagtacggttatatttttctggagacaatttactcacgtttacaaaatacgaaggacttgacccggaaagaaaaggagatggcgtatctacacaatatcctcaaaatcgtatttgttcagttggtataaatgttgaattttaaaaagattgatttatgaaaacgaaaatattatgtgttggattattgtctattctgactacattgattgcatgtgatgattttttacaaaaagatcctccttccagtccttcagagtccatattttggcagaaaaagactgattttgaatctgctttgaattcatgttattcggtagcatatgaatggccgggtgttttttcccaagcattgcctagttatgataacttgactgataattctttatgccaatatgatgaggatacgtatggtcagacaaaaagaatgatgatgggagatttgtatccaacaacgactggttttgtttccggtaatttttcattggcatacaaagctatatctcgttgtaatttatttttgacaaaattgtctgaatatcaaggtaacgatatttctgatgaagtacggaaatatatggaagcacaaggaaaagcattgagagcttattattatcattggttgtatttgtgttataaagaggtacctctgtttacagactttttatctttggataatcaatatcagccgaaagtgacaaggaaagatatttatgatcaaattataaaggatttttcagaagctattgcgggttttgatgatcgtacttatatggaggctccgggacgtatgacgaaaagtgcttgtttggcttttatggcaaaagtgactatgtttaacggcttttccgatgagaatggaatcccgtgtggtgtatcgaattcggatcaaatgcgtaaagtggtagagtattgtgaacaaataaaaggatattcattggatgaagatttgcgtatggcatttgttgagtctaaacaaatggattcgcaagaaatgatattctctgtacggtatggctctcctgatatctgtaataatgtgaatgaagtatattgttgctggagttctttgatggttcaaagaaatttagttaatgcttttgaatgtatagatgggttaccttggggagaatcgccactgacaattcctgttgatgaggatttgataaattccaggactgcagatcatgatttgatagtggctgaacgtgaaaaattgtttgaaaacagagataaaagattacgtaatagtattactgtagcatctgtttatcgttttcctgaaagggctaattatccggataatgcagtaatttataataatgaaccaagtttaactggttttggtccgatacgttttattcaaccatttgaagaaggtgttaatcctggaaatatgaaggtgggaccggatatcaatttaatgcgttatgctcatgttttgttaatgcttgcagaagcggagaatgaattgaacggacctacacaaaaagcgtataatgctattaaccaggtacgtcaaagagcaggacaaccgctattgccagaaggtttgacgaaagagctatttcgtgatcgcgtgagaaaggaatggcgttatgaaactccttttgaaggatggcgttatttccaattgaaacaatggaatgaattgaagaatgttccggaaattgttgcaaaagaacctttttattctgtagctgcaaaatatgaagatcgttttatgttctggcctttaccacaagctgaaatagacaaagctaatggtgttttgattcaggatccggcttataattaataaaagaaggctgttgctgaaaaaggtaagggtttgtttactgaatggtttagcaacagccttttttgtatctgtatattaataccatgaagttatgaattctctaataagtaaattatttttattgatattaatctgtagttgttgtgatgtgaaagaggtagaacatgtggaatttctacctctatataaaggtgaatggagtacgccaccatctaacactcctactaataaggtgccagatggagccatttgtggtaatggtgatatcggaatggtttggggagggactccggataaacaagtcttttatttttctaaaaatgatttttggaaagcacagaacgggtatcccaatggcggggtttgctatgtaggacaattacagatttcctctcccgctatggaaggggcatcttatcacgttgaacagtctattgccgatgctacattgaaaggctcttttgcgaaagcagatggtttttcataccgattaaatgcttggtgtgctgcaacgcaaaacatggcattcatagagttggaggctggcgacaagccgcttcatttaaacctcgatttcgtgatggatgaaagtatgggggcacagttgagtaatggttgcacggatgatatcaattggtatgtacgcaaatttgacagtcaaactttggaatggccaacagccgtgtcggtgggaatgtttactctggataacaagaatctgtccggacttttattggaaaaaggccaaaaggtttttgttgttttatcgttttgtacaaatcatgaacagcaagcttatgtagaacgttccgtggagcttcttaaagcgataaacaaggaaaagatagcatttttgtttgatgagcataagcagtggtggtcttctttttggaatgaatcgcaggtggaactaggtgatcctatgctggagaaatattattatggttcacaatacctactggcttgttgtagtcggaatacagatttccctcccggattatggggaacaagcctgacaatggatgcgacagccggaggatgggcaggtgattatcatacaaattataactatatggctccctggtggggcgtttattcctctaatcatatcgatttgtcagaaccttatgatactccaattttggaatatatggacaaagcacggtcgcatgcgaaagaatttttaggtaaagaaggagtttattatccagtcggtatcggtcctaaaggtttttgttctagtatgtttcctcttacatccgaagatatgatgaagcagtacggtactcctgatacaggtattgaaggtggctatatgtttttgggacaaaaaagtaatgccttattttgtacgaccaatatgtttatgcgtttttatcatacttatgataaggaatatgtaaagaaagtatatccttttatccgggcagttgctgatttctgggaggattatttggtgtatgaaaatggtcgctatgtcagttataacgataatttttgggaagtgggaccttgggaaggtaagaattggaaaaaaaattttggagatatcaatccgactgtgtcattggggttatgtcgtatgttatttactggcattattgaaatgagtagatttttacagactgatgcagacaaagtggaaaaatgggaacacatcttgaatcatttaagcgagataccgactgtggatattgatggaataactcgtattaaagcctgtgaaggaggaactgggtcaggaagtcgtactgctcccggatttggaagggtcatgatgcacggattggtgttcccttcaggggtatgtggtacggtaactgattcaactatgtgcgatattttgttggacgaggtgtatcgatggaaaaccgatacattacaatgtagaggtttgaaagatgcccattgggataatctgggtaatggttttgaaacatattatacggctgcggctcgattgggatacgatggtgaaagcttattatcagagttaaaaaaacgtataaataaaactgcattacccaatttgtggattgaacaagccggaggaggaatagagactttgagcgctgtaccttcttgtatcaatgaaatgttattacaaggatacgaaggtgtaatccgtgtctttcctatatggccgaaagaaaaaaatgccaagtttactaatttacggacttatggggcctttttagtttcttcttcttgtaaggatggggagatagaatacgtgacaatcgttagtgaaaagggacgaacatgtaaaatagagaatccttggggaaatacaacttgtaaggttatatatgtcaatggagaagagactgtttataaatcacaacagttcgaaataaaaacatctccagggcaaataataaaactagtacgattaaattaatagtaagtttatgaagatgttgaatttcaattatttgatattgtggtccttgtgtgcttgttcttcagccttgcatgcgcaggatgcaacgattcggttggagactactccgacagatgacttatctttttgtgttttttataaagggaaagaagtgataaggaaatctcctttgggaatgaccattgataatagagccatcggaaaagaggttcgaataaaatcagttactcccggagagcagacgaatggcgagagattatgcacttatacgattgaaagaccggaaggagatatctattatatcgatacacgcgaatatgcggacggaatagccttacggtacagaataccggcatcgacaaacatctgtatttatggtgaagcaacttcgtttacgtttccttcccgtacaaaaacatggtatgcgagcggccctttccaatatggctggttgcaggagtaccaggatcggtttaccgatgatatagagggggagatactagctcctccagctacttttttgacacctgacggagtatatgcggctataacggaagctaacctctttaattatcatggtgcggttttattagggactgagcctaatcaggttcggttcggctatgtggaaaataagggacatctggagactggagttattacaggattaccgccttcaaaatattggcatgaagcggtaaggaatgtgccttggattgtctcacctaaagaaggtgtaaatgaagtgataactccctggcgtgttttgatgttggccgaaaacttaaacggcttggtgaataacaaaatattggcaaaggtttcggataaaccagacaaaaatcttttccctgatggttcggaaactgattggattaagcctggcagagctacatttacttggttggtggaaggtaaagatcgcctgagtatcgctaatcataaaaaatatgtagacggatgtgccgagttgggaattgaggccgttgtggtggatgacggctgggagttatggcaacagacagaaaagaatgcgaatggccggacaaaatgggaaatgttgaaagaactggtcgattatgccggtgaacggaatgtaaatatatgggtatggcgttcttcatccccccgttccggtaataaaacggatatcggattagtcgatccgaaagaacgtgctgattttatgagaaagtgttcggaaataggtgtcaaaggtttgaagatcgactttttccatacggaaaatctatttacggtcaatctgatggaaaatatattaaaggatgccgccaaagagaaactgatggtcatctttcatggtgtgaataaacctaccggcgattcttatacgtatcctaacttactggcgaaagaggctgtccggggattggaaactgtaggaggagagaatagctgggctcccggtccaccttggccttatcataacacggtcttacctttcactcgttggttagtgggaccggctgattatacctctttaaacttccgggctttttgtccgccgtctataacgtttgcccatcagctttcgtctatttatatgctgacatctcccatgttgatctttgcagccgatatggaggacatgctttcgtctcccggccgttcgtttattgaaagtgtccctgtcgtatgggatgaaacgattgtattgccggaaagcgaaataggtaaattggcagcactggcccgtcgtaaaggagatgtctggtatttgacagtcttgaacggggaagaggccggagtgtttgaaacgaacctggattttttaccgaaagggaagtataagatggagatagctacggatactcccggtaataggaagttgatcgaaataaaagaaagtaagatatgttccggtcaaaaaatgaaagaacaattgatgtccggaggcggatttgttgcccggatatctgctatttgaaagcattgaaattgtaacgttttgaaaaacagtattataatgttatctaagtagatgttatgctcctgcttgtatggatattattatactataataaaaatctttcattccttcatctgtagatactatcttgtttaagatcatttatttacagatgaaggaaatgaataaactctcgtgctcctatccccgtctttttctatatgtctcgtcctgattttagtggttcttttcaactaaattgcaaaagaaccacctatttcaggacaagtcatgtaggtgtttgaaaaggtaagcagacggctcatacgtcagttgccgtcattgaaagggtgggaaccaatagatacagaaagcaataataatccacagaataagcagctatttgctattttttatagcaatggctgcttttatatttgttggctgtatgcaaatggcggaaacagcgaagtggtgacattacaatactgttttgtgaaacaaagttaaataaccacagccgagtcacggaaactataacagtatagtatccttactatagattcggtaataatgtatcatttatagaaaaaataccacgaatgcacaagattgagcagttatcagatcagcagttaatgaaggagatcatatctgataactttaaagctttcacagagctttacaatagatataaacatactctctttcagtttgtcatccgactttcgcacggcgatcattcgatggcagaagatgttgtgcaggagacatttattatcatttgggagaatcgaaggaagattgtagtggagttctcattccagggttatctgaaaaaggtatcccgtaacctattcctgaaagaaacggcaaagcgtatccaggaacagttgatgatctcacaaatagagaatgttagcgaaacagagaatactgtggagaatgaagtcgaattgaaccttttgctggaggaagtcgaacgaatcatatccttgttaccgcctgccagacaaagagtttatcgtctgaaacatatagagcacctttcacaaaaggaaatagcgagccagttgggtatctccgaaaatacggtggaaagtcatctgaaacagtcaacgaagttcctcacccagatgttgaaagtgaacagagctgacttgctaaatgatatagttttattgctttatcctattttttcattcttattttaaaaagactatgagtagacaattagaactattagataaattctacgacaacaaggctaccgaaagtgaaaaacgtcagttagccggactgttgaatgattcagatcggtgggcggatgattttgacgaaatatgggatcactcctttggtaatatacctgagccggtaaatgagcgggtttttaaggcactaagtgcaactgctaaacctgtaaagattaatgtcaggaaggtttttatgcgcattgctacctacgcagctgtttttggtgctgttgccatatccttattctattggaacgagaaccggctgttaactaaatataatgatatgaccgtagaagtaggccagggacaaaaatcggatatttccctaccggatggcacaatagttcatctgaatgccgattccaaactgtgttacggcagtcattttaacgggaaacaacgtcaggtagaactgatcggcgaagcctattttgatgtggcaaaagatgcccaatctccttttatcgtaaaagcaggagatatccaggtgcgtgctttggggacttcatttaatgtcaaggcttatctggaggatcaaaatatcacgacttatctgacagaaggttcggttatcgtttcatcggcatggcaatcttttgagttaaaaccgggagaggtagctgtttattcgttgaaggaaacgcagatggtaaaaagagaagaggaaaacgagcggttgtttacggcttggatgaatgatgaaatagtatttgaagatgagccggtaacaaacataatcaagttgctggaacggaattataatgtgaaattcatgctaaaagatgatcgattaaatcaagtcacattttcgggaacgctgaagaataccagcttgcaatcggctctttatgcattgcagtttactgcttctatttcttctaggaagaaagaaaatgtgatagaactctatatagattaaccttttaaattcagataggatgaaaacataaaaaagaaacacacaaaaaagggaaagcgcttgcaacactttccccgtcagtcaattgaaagagcgatgtatcaataagaagctctttattaattaacctttatttgttatacaaaagtatgaataaaaaatcagaaaccatttcttcttttttattaaaagggaagattctcagaagaatgggggtattgtttgcttcggctgtcatttcttcttctgtttttgcacaggtaacagtgagtgtaaaacaacaaacgattaagcaagcgttacgttctatagaacaagtttccgactatcggtttttttatagtaaccaacttccggatttggataagaaagtcactttcgaagtgaacgaccaatccatagaggcggcaatgaacaagttgctgaatggcacaggcttggtctatgaaaagagagaaaacaaccaaatttatctgggagtaaaaggcggagaagaaaaaggaaaagagaagaagatcaccggaacaattgtcgatgataaaggagaacctgttattggtgcgaatgtttctatcaaaggaacaacgagtggaagcattactgacattgacggacatttcagcttggaagcaaagtctggtgagactttgttcatatcctacataggatatgaaactcaggaaataatgatcggtaatccatctgtttataacataaagctatcggaagatacccaagcgctggaggaagtcgtggtaattggttatggcacgcagaataagcaggcgattaccggttctatctctaaagcaaaactggaaacgtataatattgttccaacaaacaatgttcttgaaacgataaaaggtagtatgccgggggtgaatattggtggaacaaatactgccggtagtactccttctttctctattcgtggtcagaattctactcgaaatactgctgaagataatggaaaccaaccgttagttgtagttgatggtgctatttttaatggtagtttgagtgatataccttcggatgacattgaatcttttacggttttgaaagatgccagtgcggcagcagtttatggtagtcgctctgcaaatggtgtcatattgattcagaccaagcgcggacgtagtaaggatggtaagcctacttttaacgtgaatctctcttatggtatcagcaatgagatggagcgtttgaaaatttatgatgctccaggatatttgaaacgtatgctggatattcgtagtctgaacggaatggaggctgaccccaataaaataccatactatttggaagtagaagaaaagaagaactatgaagctacagccgagcatcgtccgacggtagaagacccatacgatcagtttcgtcagaatgcgtatgatttgaaagcgaatataagtatttccaacagctcagatctggctagttattatatttcagcgaatatgacggaccagaagggagtcatgatgaacgaccgttataagaacttttccggtcgtatcaatattgacacacatctgactgattggttgaagataggggtgaaaagtaattacagtattcgtgattattcaggaagtgctccaagtatggaacaggcaactcattttagtccgtttgcttctatttatgacgaaaacgggaattatttgcaatttcctcaaacaacgacctcttttcagagtccttattggagcatgcacaccagtgatacggaaaagtataacaacctgggagccattctggatgcaacgattacgataccttgggtaaaaggtctgtcttattcgatggtctattcaaacaatttgcgttggtctcagaaatattacttcgacaacgaatttacgactgaaggtttaggtaagaacggtaagggcgaacgtaaattgaataacgactacaatatgttgctggataatatgatcaagtataacaatacatttggaggtaagcataatgtagatgtgactttactgtattcacgtgaacgtagtacgtgggaagaaacgaaggggtacggagaaaacttcgataatactgtattgggggataacaaactggaagatgcaaagaaacagacggtgaatacaggttcaggagagagtggtgctatcggttggatgggacgtgctacctatacctttgataaccggtattcaattaccggtacagtgcgtcgtgacggttattcaggctttagcgtgaataagaaatggggtacgtttgcttctgccggtgtaaactggaatatttcccgtgaagcatttatgaaacaggtaagttttgtggataatttggcattgcgtttatcttacggttcgaatggaaaccagtctattagtccgtatagtacattggcgaaagtcggaacagacaaatatatttttgctggcgatccttcttactccattacgcaatatatttcttcttttgccttgaataatttgggttgggaaacaacgaccggcttcaatttcggtttagattttgctgtgttagacaaccgtttgtccggaagtgtggatgcttattctacatcaacaaaagacctgttgtttaatttagctttaccgagtatttcaggaaaaaaagaaatgttgtctaacatcggtaagatcaagaacaaaggtgtggaaattaacttacattctgtaaacatccagaataaagatttcagttggacttccgattttgctttctctctgaacagaaataaagtggccactatctatggtgacgataacaatggagatggaattgaagatgacttgattagttccggatattttatcggtaaatcgttgggtacgatctatgcctataatgtcaatggaatgtggcaacaaagcgatgtagataacggtacgattatggaaggtatgcgtcccggtgattataaattggaagatgtggatggtgatggtactatttcttcggataaagaccgccaattcatgggtaattctaatccgaactttcgttggagttttacaaatacattgaattataaagatttctctttgatgctgtattttaactctgtatggggtggaaatggatattatttgtctaataacaacacaccttacaatgatggttacgcaaataatccgaatatcaaccatcccgtatatgattattggactccggaaaatacgggagccaaatatcctcgcccggactataaggtttctgcatatcaaggtgtaaaatacattgatcgtagttttatcaaattacagaaagtggcgttgagctataatctgactcgctttgtgaaacctgtcggattggataatatggttttgtctgtgagcgcggacaacttgtttacattcgctccgcattgggacggattggatcctgaaacagatcagggagtgagggataatgcaataccttctatccgtacgtaccagatgacattgatgtttaacttttaaattgttaattgaaaatgaaagctattaaatatttatttgtaggattgttgttaacagggtctttgacttcatgttatgatctgttgactgaagaaccgaaagattttcttacacccgaaaactcttatacggataagaaaggttttgaatccgctctttcagatatttatagaaatatccgtaataacttctatgcagagaacgatgctgttaataattatgatttgttgtctggcttggatgttgacttgtatatgaagcattggaatctgggaggtccttactttgaatattatttctggaatcagtttaatgcggatcatgacatgcctaagacttggtggtctcgtttctattcttatatttttagttgtaatgtgattgtagaacgtgccgaagcaaatgttgtccgttggagttctgatgcagaaaaaaatgctattgttggtgaggcaaagtttttgcgtgcttttgcctaccgctttttagctaatatgtggggaacggctccattagtattggaagaaactaaagatcctcggtttaactatactaattcaacgcaagagcaactttacaaacaatgtaaggaggatctggaatttgctatccaatggatgcctgatatagatgatcagaagggtggtcgtgcttcaaaagtggcagcacaacatttgttgtccgaaattttaatcggattgaaggattatgatggcgctataaaacaagcatcagatgtgattaataatccggctatgcatttgatgaccgaacgcttcggtaaattgaaagattttacattcgagggatatgattaccagggagaaaaagaaccttggggtgatgtttggtgggatttattccgtgagggaaactttaatcgtatagaaggtaatgcggaatgtatctggaatgtgcagtttgatgtcgatctcgaaggcggtggaaatgtgggccaatggggaggtaactttactatagaacgttggtttagtccgacctggtggaaccgaaaagatcttgatggaaatgccaattggttgaaagccgttttaaatggtcgtccttctgctgctgcgtttgccagtgattacttgggacgacagatttgggaatataaagatgattgggaccgcgatgtgcgtaactccatgtataatattaagcgagtgcattattggacaaatccggaaagtcgtttttatggccagcctatgactgccgaaacgatggctacaccttcgcagatggactggcaggctccaatgttaatgaagtttgtcagcgatatacctcatggtcagttccaggatccaacgagtaaagaatggcatgataatggccgaacttataaagattggtatatcatgcgtttggcagaaacttatttgttacgtgcagaggcttatatgaataagggagatttatcggctgctgctaatgatatcaatgttatccgtaaacgtgctcatgcgacgcctgtggtttcaagtgatgttaacatcgagttgattctggacgaacgtgcccgtgagctgtgtatggaagattttcgtctaaatacattgatgcgaaccgataagttagtgaatcatttaggtctgtataacccacaagttatccaagccggatataagttggatgaccatttgaataaattacctattcctaattctgagatagaagcgaacaaagaaggtggtttggttcagaataaagggtataattgatcgttttttatttaggctttagtcgagaagaggatgtgtcgatctgttccgctttcacataagggtggagatttagaacttttgccacatcctctttttctttagaggagggcgagtttaggtgtttttttataaaggaggatgattgatgaagagtttttatataagtatattattgttttggactgtatcttttgtttgggcgcaacaggtcttattaccgatgcctgccatgctacagcatggagggggaagtttcgtatttagtaaggaggtcgaaataataacctggggaatgtatgccgataaactaggcaaggaatttcgacaagaattagaaggattggctttgtcgcaaaaaaaagaaagcggtgtaattgtttttgagcaaaatgtgcagtctggaatgcctttggatgcttatgaactgaatattggtcgtgatacggttctactcagtgcttcaactgaatccggtctgttttatgccaaagcagcattactgcagttgattgattttcataaagggacgattagcgtttgtcggatccaagatagtcctcgtttctcttggcggggattcatgctagatgaaagtcgccacttttttggaaaggaaaaagtgaagcaatatttggatataatggtatctttgcgtttgaatgtttttcactggcatttgacggatgaaccgggatggcgcatcgaaattaaacgttatcctaaactgacaacgataggagctgtcggtaattggcatgatccgaaggctactccggctttttatacgcaggaagatataaaagaaattgtagcttatgcaacagaacgtcatatcatggtcgtcccggaaatagatatgccgggacatgctacctccgcttgccgtgcttatcctgaaatatcaggcggaggaaaaggacgttgggatggatttacttttcatccatgcaaggaggaaacattcgaatttataagtaatgtactggacgaagttgtcgatttgtttcctgctccttatattcatatcggaggtgacgaggttcattatggaaatcagaattggtttacggatccggagatacaggctttcataaaagagcataacttgatgaacgaaacaggtctggagcattattttgttcgtagggcagcagatattgttgcctcaaaaggtaagataatgattggatgggatgaaatagtcgatgctgaggtttctccggaaaagtcggttgtcatgtggtggaggcacgatcgtaaatatcaactggtgaaagctttggagcggggatataaagtgattatgacaccacgtttaccgttgtatggggattttgtgcagtatccgacacaccggatgggacgttgggacggatttaatctgttggaagatgtgtatcgttttccggctcctgttatgaacttggtgcaagggtatgaaaaccagttgctaggtatccaattttcggtatggagcgaacgtattgcagatagtaaacggctcgattatatgacattcccacggttgctggctatggcggaagcagcctggactcctgtttacaagaaatcgtacgggaagtttatggaaaaattaccttattatctggccttattgggaaaaaaaggaatttattattttgatccgttcgcccctttttctacaccggaaccttttgctccggataaggaagatacattaaagaacggataaaggtattgagagaatagatgttaaatgtgaaagtaatcatatcatgaaaagaacaattgttttatttgctgtcttattacagtcggttgttgtttgcggacaaactgtaataccattgaaaagcccttcggaaaaattgaatgcagaaatccaggtaaagaatcaatctgtacaaattggtttgtatgaaaaaggagataaggttgtagatgtgaaaacccttcagttggatttggaagaagaaattttgtgcggtaactggttggtcaccaaccaaactagaaaagccataaatcaaacctggcaacccgtatatggagaacggtctcttgtgacggaccagtataatgagttggaattatcgttacaatcggatcaaaaccaaaaggaaatgacactgttcattcgtttgtacaatgaaggtttggcttttcgctatgctttcgataaactagatttctggaactgtacgttgacggctgaaaatacgcagttcctctttgctcatgactgtgatacctgggttaccggtatggcgcaaggtacttattcgaagaagagcttgagtgcattgagtggagctgctgatcgtccgcaggttattcagattgatgaccatcgttttgttgcaatcggtgaagcggctttggtcgattattcccgtatgaaactggaaaagagtgaaacaggttttggaatacaatccctactatcgggaaaggtaaacctggatttggcaaaataccaatccccctggcgctatattatggtggctactcatccggggcaactggtacaaaataatgattttgttttgaatttgaatgaacctaaccaaatagcaaataccagttggattaaaccgggacaagtgattcgtgaagtaactctaacaacagccgggggattggcttgtgttgattttgcagcagacaatgctattgaatatgttgaatttgatgctggctggtatggagatgaatacaatccggagtcagatgcatcaactataacagtcgatcctaaacgttccaaaggtccattggatctccaccaggtaatcaaatatgctgatcagaagggagtagggattatattatatgtaaatatgaaagcactctctaaacaattggatcagattttacctctttataagagatggggcgtgaaaggcctgaaatatggttttgtagatgtaggtgatcaatattcgacagcttggttgcatcaggccgtacgtaaggctgccaagtatgagttgatggtggatattcatgatgaatatcgtccaacaggttattctcgtacctatccaaatctgatcactcaggaaggtatccgcggcgatgaagaaagtccgtcgttggatcaggctatttatactttatttaatcgtatgatttgtggggcaggcgactatacaaactgttatttcgcagaaagagtcacagaaaagatgggaggacgtgcaggtcaattggctaaattggttgcaatttatagtccctggcagtttgtttattggtatgaccgtccggaaaaatctccggcacgtgcaggcggagccggttctgctgaatcggtgataaagacggatgtagtaacccgtttttataattctattccgactgtatgggatgatacgcggtttatggatgggaagatgggagattatgccgtagtggctcgtcgttccggttccgattggtatatcagtgtgctgaacgcaggagagaagaagcaggtatctgtcccactggatttcctgaaagatatgacagcctataatgcaactctttattatcaggctccgggaaagaaaaaggatgtggtaagcattaaaacgatgaaattacaaccgtcgttgactttggatgtcgaggcaaacagcggatgtgtattgcatattacccgttgagaaataaaataaataggcaataataatccacgaaataggcagctattagctattttttgtagttgtagctgcctttatctttgtttagtaatattggagggagataaacaatgaaaatgaagttaatcgtatggagcgttttggttttacaaagtgtttgggcttttggtaagagtgagggtcggcaagcgacaatacttgtaaaacctggttcgggaaccttgctgcaggctattcgtaaagcggcatctttggaaggagatgtgatcattgaaatgaagggcggcgaataccgcacggacaaaactatcggaatccacccaggtaaatggtcttctttactgataaaagcgagggaaggagaaaaggtatccgtatccggtgataaagtgattccattaagtagaataagacaagtgaaagaccaggttatcctgtcccgcctgcaggaaagtgtacgtggaaaagtggtagaggtggattgtaaaggtattgtcgaggctttggctaatatccgtccttccggttttggacgatcctgtcgggtgtttggatggatggcgtaggtaaccgggttaccaaatgcgacatatcggatgcaccgagcatggctatcctgtttcatggaaatgagcatacgatagaatattgtgatattacgcaggtttgtcaggaagtagacgaccagggtgccatttattatggacgtgagccgttggaacgaggtaatgtgatccgttataattatttccacgaattaagtccgcgtcatcgggtaacagccacttaccatgacgatggtgcttgtggaagcgaagtttatggtaatatctatttcaaagccggctcattgcctgtactgattggaggcggaatggatcataaatactataataatatctttattgattctcctacggctattcatctggataatcgtttacaaaactgggctggaagcatgctggataaaggcggtatttacgacaaacgcttgcaggctgttaattatacgcaaccaccttatggcgtgaaatatccggaattggttaattactggcaggaagacccggcttttccgaaacggaaccggatatacggcaatctcttttataatataaccaacctgctgcatggcaacagccagtggggcgaattctggaataactgggcgactaatgaagatccgggctttgtcgatccgtccgaccctttaaaaggattccggaaagatgcccctgtctttaaacggataaccggttttaaagagattccttatgctgagatcgggtcgacgttgaaataatcttaaaagtgtttcaccctgatgaaacaagtgtttctcctaaatgaaacaactgtttctttaaggtgaaacacttttgggcttgtagtttaacgattttagaaaagctgatatatgcagttgaataatctgttgtttcgatttttctgatgacggagtaagtaaatgtttgatttaaatcgtttttgttgtgtaattgttataccggcgattctaatcttatgaaattaagtggagaaaagggagatttgattccacgggttgaggtggaattatttaaaaagatatatgtagcctatacccctgacttagttgctacagcagcccggtatgtcggtatggtaacggcagaagacctggtgcaggagctttttttgaaggtttggaatcagaaactctttttatgtgtcaaagcttccgaacttaaatattttttgtttgcatctcttcgcaatgcctgtttggatgtgctgaaacacgaagaggtaaaacaaggatatgccgagtattataagaaagagttgatgatggaaatattatcttgctctgaacagcctttttattatgaggaagaaaacgacagcctcaatactctttttgggaaaattaatcaattacctcctaaatgccgggaaatatttcttgcctcttacatcgatgggaaaaaagcatccgaaatagccaatgataagtccatctcacaacgtacggtagaagctcaattgtataaggccttgaaaatactacgcggagtgctgactatatttattttattttttttcatttctgagtaagtaaatctttagtgaaaatcgttttcgggatagaaaagcaaaataatggaacataaagaacatatcgattatgaaaagttactgatccggtatctacaggatacagctgatactcaatctttgcagcagctgttggatattgtccggaaatcggaagacaagaaacgggagttggcagagttgcaatcagtttatgattctttatccatacagcttgatgcgcaaaaatatccgatagaggctagttgggagaagatgcggcagaaaataaatgtggataaacaaccgaaagtgtctcgaaagtccataactctattattgtcttatgctgcaattatcctattggctttgtcgttgggcatacagtatttgtattatcgtaatctccgtcaaccgcaagaggtggcagatagttatacacgatttgtggtggaaaaagggggaggaaaaagctctttgttccttccggatggaactaaagtcctgttgaatgccggaacgactattcaatatccgacacgcttcgaccagaaagaacggattgtgatgctggatggtgaaggtttttttgaagttgccgagaatcagcagaaaccatttgtcgtccggttgaaaggacatgacgtaaaagttttagggacagtctttaatgtaaaggcctattcggatatggatcatactgtgacctccttgatttcaggaaaagttcttttgacttcttatgatacggaaggttcgatatgtgaagaacaagttttacatccggatgagacagcccgtatcgataagcaaaccggaacaataatgactttccgtagtgatgatgagtttcagttagcatggacaaaaggtctttataaatttaaagataaacctttctcggacgtaatgtctgaactggaacatctgtacgatgtaactattttgatagaagatgacaaactcgctaagtctgtttataccggtagtttggttttgaaaaacacgatcgaagaggttttgaaacctttaggccaatacaataagtttcggtataggaaagaggggcatgtgatccgtatttactccgaaaaataattgttttgatgtataactttaaaaatagaaaggatggaaccaccagagaagtaaacaattaaaaaaattcgggaaatgccaggcacctcccgaactattattcatttcagtcttcccgcgaacgtcggcaaacagtaacggaaagacttcaaacttaaaataatacacaaaaatatggaaaaatatcaagagtggggctttttgtctccaaaaataaggcgtatcatgaaattaacactggcttttacgctattatgtatcatacatatatctgccaatacgtatgcacagaccacacaggtatcaatagatgttaaaaacggtactttttatgatgtggtgaaacaagtggagaaacagtctgaatatctgtttttttacaatagtaaagatattcccaacgatttgccgtttagtcttcagaagactaaatccaatatcactgtgatattggattatctggtagaaaagtatgatttgtcatataaaatagatgacagacagatttttttgacaaagaatgcggttattcagcaacaacaaggaaaacgaataacgggtatcgtaaaagagccgaacggtgaaccgataattggagccaatgtgatggaaaaagggacgaccaatggaacaataacagatgtagatggaaagttctctctggaagtcttttcggataatgcgacagtgattatttcgtatataggttatctttccaatgcggtatcaatcaaaggtcaatcggtgtttaatataactctgaaagaagattctcagagcttggaagaagttgttgttgtcggttatggaacgcagaagaaggccactttgactggagcggttagcaatattggtaacgaagaattgataaagacgcgtagtgaaaacgtaaagaatatgatttccggtaagataccgggagttcgtgttgtacagaagtctggtgaaccgggtagttataataccgatatgcagattcgtggtatgggtaccccgttagtgattattgatggtgtacctcgttccaatatggatcgtttggatccgaatgaaatcgaatcattctctgtattgaaagatgcctctgctgccatttatggtgtaaaagctgcaaatggtgtggtaatcattacgactaaacgtggtaagactcctaaactgacattggactacaatggttctgttggttggcaacaggcctcgaacattccggaaacactgaatgctgcccagtggatggagttgaccaatgaaaacgcaatcaatcagggaagaagtttgatgtttacacaagaagatatagaccagtatcgtatgggattaaaaccggaaaccaaatggtcggatgtcggttttgataaaatagctccacagacacaacatagtatcagtgcccagggcaaatcggataaaatagattatttcatgaacttcggttacatgaagcaagatggcttctattccagtggcgacttgaattacgaacggtataatgtgcgtaccaatatcaacgggcaaatcactaagaacttgaaagttgggatgcagttgaatgggatgatggggacgaagaacgaaccgatcatggatgcttgggaagtgtataaagctgcttggatgcatataccgacattaccggtttatgccaataacaatccagcctatttgcaacagttgccaggtgcttatcatcccatagctttaacaactgcagatataagtggagcacgcaaaaatcatcaaaaattatttcaaagtacttttacgttagattatgctgttccttttatcaagggtttgaatgttggggcaatgtatagttatgattatgatagttctgataatcgttattcaaggaaggagtacgcattgtacgaatacgatgctgtagctgattcttatcaaccatttaaagcctattctccatctcgaattaatcgtagttattataaggatgaaaagaccttgttgcaattgaaattaaattatgaacggacatttaaagaaattcataacttaaaggttctgtttttgtatgaggagacaacccataaaactgataattttgcagctcagagagatttgccgatggatgcggtagatgaaatctttgcgggtgcaaccgataatcaacaggcaacaatgaatacagacccgaaagtctttttcgatatggcaaataaagcttttgtaggtcgtatcaattatgattttaagtcgaaatacttagcagaatttagttttcgttatgatggttcttctaaatttgccaaaggttctcaatggggcttcttcccctctttcttgggggcatggcgtatttcggaagaagacttctttaagaattgtgaggcgttgtcttttataaacaatttgaaggtgagaggaacgtatggtgtgctgggagacgacaatgcttctacttatcaattcctgtcgggttatacttatccgagtggcggatatctttttaataactcgtttatcagtggattgggattccgggggatggctaattcgaatatcacttggtttgaggcgcatactgctgatttaggattggatgtagatatgtggaatggattgttgagttttcaaggagatattttccgtagatatagaaaaaatttgttggcaactcgttcgctttccgtaccgggaaccttaggggctgccttgccacaagaaaacttgaatagtgatttgatacgtggttttgagatcggattgtctcatacgaattcgattggtgatttccggtatacgatttccggaaatatctcttatttcagagcaatgaataaatacatcgaacgagccgagtcgaacaattcatacagaaattggcgggataattataacgaccgttatggcgatttttattggggatatgaatttgttgactatttccacaatatgggggatatttggtcagctccggtgcaggataataaaggaaactccattctgcgtccgggtgattaccaatatatcgattggaacgaggatggcataattgatgggaatgacgagcgtccgattgatttgaaaggtgatccgcgtatcaattttggttttacattggcaggctcttataaagggtttgatgtgaatttattgttccaaggtgctgccaaaggcacggtgatcaatcaggtacagatggaacgtccgttgacttgggaccgtggtggcttgtctatgtttatggatcgttggcatacggcagaaatgggagctgatacgaaagatcctaatacggagtggattccaggatattatccttctaccaacaatggaggagagacaacaaactattggacttcttctcgtagtattcaaaatgtcaattatttgcgtttgaagagtgcagaaataggttatacatttccgcaaacgtggatgcaaaaggtgggtatccaaaacttacgtctgtatttcaatgcctataacctgtttactttgacaggattgaagtatattgacccggaacatccgagtgatagttacagttgtttgtatcctattacaaaaacgtataatgtgggaatgaacattacattctaaacttaaattgtaagaacatgaaaaaaataatagctagtctgtttttggcgatcttaggaaccagttgtaattcattggatgtaccgcctgttgatatcattcaggataaggatatttttgcttccgagtccggtattacagcttatatggcttcgttatataatgatatgccgataccaaaccatggagctacggtttggggatttaataattattggaatacatggccgcagggaggacacatgtcgggcgaattgttgaacaatcagttgttctttgtgtataattcgccttccggggatatgtttcagttttgggcatacgaccgggtgcgtaagatcaattactttatagagaatatgcctcagtatgaagccagtttcccggcagacaagattaatacttggttaggggaagcctacttctgtcgtgcttattattattttaatatggtaaaacggtatggcgcggttcctttggtaaaagaggtgaggaactatcccgaaacgaatatcgaagagttacaaatcccgcgtaatacacaacaagaaggttgggattttgtagtggaagatttggataaggccattgagcttttaccggaagaaagcattgaaaaagggcgtgtcaataaatatgtggcgtatggtttgaaatcgagagcaatgttgtatgccgcttccatttgccaatttgatactccggctgccggttatgaagaattgttgggtatgccagcatctaaggcacaaagttactatctagcagcttacgatgctgcttccaaactggaaggtaaatattcgttatacaacaagtttaccgataagtttgagaattattggaatctgttcttggatgaagataatccagaggtgatatttgcgacttattataaatatccggagcgtgctcacagttgggatgtgcaccaggtgccatttcaagtcagaggaccggaaggatattccggtatattgaatccgacgttggagattgtggagttgtttgatgatgtgaatggcaatctgtttgtgttgaaaacaacagatgccggtggtaatccgattcgttacgacaatccgtatgatatatttaaggatgtggaaccccgtttacgtgcgagtgtaattcttccgaatgatgtattcaaaggagaaacgatagaaatacggaaaggcatttggacgagttatccggatggagaattaaaaacgacaacggatttttctgccatgtatcaggatatgaccatacaaggcaaaagtggcatggggcataatgaagcgacaacgacgggattcttggttcgtaaataccaagatccgaccttggaaaatagttatgtcgttcatggacattccacagcccagtatatcgaaatgcgttatgccgaaatcttattgaacaaggccgaagccgctttctatctgaacaagaagcaggaggctttggatttggttaaccaggtgagagaaagagccggtgccaaattgtacactttggagcaattgacagaagagaatctccgtaaggaaagacgtatggagttggtcttcgaaaagcatagtttctgggatttgcgcagatggagaattgcggataagttgatgaacaataagaaatatactgctttatgtccgtattatatttatgatgaaggtaaatatatctttactaaagaggaggtaggtacaacttatacatatgatgtaaaagtaaattatgccaaagtcccggatggtgaaatatccaagaatccgaagctgttacctaataaccccgggtattaatcttataaatgattattgaaatgaagaagaatttattaatgtgtatgttgtttgcattgggtatgatgtcgtgtggcgatattgataacatggaaggtcctaatgcagcgatagcaggaagtttgatagatgaaacgactaataaacctattatatctgaacaaccgaatggtttcagaataaagatggtagaaacgagttggagtgaatcggcgacaccggaatatttctggggaaaagccgacgggacatttaaaaacacgaagatatttagtgcgacttatgatgtacaaccggtggaaggagctttctttccggtagaaccagtatctgtaacaatcaagaagtctgaaaatatagactttaaggttactccttatttatcgattcaccctaaaaaagtagagatagcaggggacgccattgaggtggaatggactatatctcgtccaaaagtaggtgataagatattggatacacgtgtgtttgtggttcatgacaacctgaatgtggggacaaactattttacaacggcattgagtccgatgatcgatttgagtagtgttccggatgaggaagccttgtctacaacgtacaaacagacgattaccggattgaccaaaggtaagacttattatgtaaagattggtgcacgaacggacaactccagcaaacgctacaattttgcagaaacagtgaagttggagtattgatatggcatgtcggaaccttgttccaaaaggatgacgatgaccatccggtcatcgaataaaacgggaggtgaggaggatgctgccggtctggcaatcttactccttagacttagatcgtctaactctaggcacttagccggtctaactcccgttggttagggtgtctaactcccgggacttagacaccctaaccaaattatccccgtttgaggagtacttttgtaaactgataatccaagcaataataatccaccaaataagcagctatttgctattttttatagtaatggcggtttttatcttcgtacattgaaataaaagtaaatatcatgagaaatattctgaatcggattttaatattaagcttgtgttgtaatatgttgcaagcgaaagagtaccatgtctcaccccaaggaagtgataagaatgctggaacaattgaggctcccttcaaaaccatcaatcgggcggctcaaaaggcattacccggtgatgtggtgacggtacatgaaggagtgtatcgggaatggataaaaccgatgtatggcgggaccagcgataatcggcggattgtttatcaggctgccgaaggggaaaaggtggagattaaaggctctgaagtgatcaaaggctggaagaaagagggaaaaggtctttggaaggtggtgattcccaacacgcttttcggtgatttcaatccttataaagaattgtttgatggcgactggattatcaatgacgggcgtgtcacgcatttgggggaggtctatttgaatggcgaggccttctatgaagtggattctttgagtaaagtacaaaatccgaagccacatgtatgcaaggctgatccggaggggacggttgacttctggtattgtgaaacggatgacgaaaacacgaccatctgggcgcgtttcggtactgtagatcccaataaggaatgtgtcgaggtggtagcccgtccgacctgtttctatccggataagcagcaactggactatatcaccatcaaagggtttgaaatgagccaggccggtacgaagtgggcttcgccgacgaatgagcaggtgggcgtaatcgccacgcactggtgtaagggttggattatagaaaataatatcatccacgatgccaagagcacaggcattacgttgggtaaggagcgtacaaccggcgacggggtacttcctaccgatgatgccgatggagtgaaagatgggcatatctcttatatagaagtcatattcaacacgacacgccatggctggaacaaagaaacgataggttctcacattgtccgcaacaatacgatctataattgtgaacaaacggctatttgtgggacgatggctgctttcagcgaagtctacggcaatcatatctacaacatacacgtaaaggaccagtataacgggtatgagattgccgggatcaagtttcatggggcgatcgatgccgtgatacgggacaaccgcatccacgattgcacctcgtttggcatgtggttggattggatgacgcaggggacacgggtgtcgggcaatttgtgttatcgtaattcgattgatttgttcatagaggtgagccacggcccgtatattgtggataacaacctgttcctttcccctcattcacttatgcaatcaacggatgggggagcttacctgaataatctttttgggggaaagttgaccttgcaagcagactatacccgttttaccccttaccaattgaatcattcaaccgagctgaaaggtgtaagtccgataaaacatggcgacctgcgtttttataacaatatttttgtgagcggagctgataagaaattgtatggcttggagtttttgaacgaggtgaaaggtgtgatctatgccgaagacaatctgttttgtaatggtgcccgtcctatgaaagagaaggaacagggtgtggtggatgatgcgttcgacccttctttcaaggtggaagaggttgcggatgaagtgtatattacattcgaaggaaaaacgaaattgtcgcagttgaaaggtaaaccggtcaataccgaccgtttgggagttgccgagttgactacctatccgttcgagaatgcagatggtactccgttttcattggataccgatttcttgggagaagagagatcaactgtctctccttctataggcccgtttgaaatagtatcaggcaatcgtattaaggtttggtgatgtttagctagcaagcgacaaatctaccgaatgggctggaagaagaatgtttaaattaaaaaaatacaagatgattatgaagcgaatgttaatccttctactgctggttgtgggaggattttgccagttggtggcacaggaagtaaatacctctgtcgataaagtttacgtcgtttttaagacgcacctggatgttggttttaccgatttgagttccgtggtgacacaacgttatatcacagagtttatacccaaggcattggatgtgtcagaaaaactgcgggcagagaatgcaagtgaaaaatatgtctggacaacaggggcatggctgatttggaaatatctccatacggcatcgccagaggaagtgaaacgcctggaggctgctatcggacgggggaatattgtttggaactctgttccttacaccgtcgagtcggaatcgatgaacttggatttgtttgaaacaagcctgcttctttctcataagctggatgaaaagtacggaaaaaagacgattgccgctaaaatgacggatgtgccgggacatacgcgtagcattgtgtcgccgatgagccgtgcagggattcgttttctgcatattggtgtgaatccggcttgccctatacctggtgtaccggagttctgccgttggagagatacggatggtagcgagttgattttggtctatcagcaagattacggctcggagaatatacttccgggaggaaaggctgttatttctatcaactttaccggtgataaccacggtcctcattcgtatgaaaaggtgaaggagatttatgccgacctgcataagcgttatccgaatgcccgcctggtggcttgttctttcaatgagattgccgaagagttgattgccatgcaggaccagttgccggttgtcacctctgaaattggtgacacttggatttacgggtatggaagtgccccgatacgaatggcgaaattcagagccttgtctgaactctattcccaatggttgcgtgaaaagaaaatcgacaagaacagtgatgcagcactcgattttgtattggaattgggtttgattgccgaacatacgcagggagttgacgtgaaaactcatcttcataactgggataaatatgatatggaccttttccttccggctcgtgctaccgtaccttttcggaaggcggaagcatcgtggaaggaattggacgattatatttataacgcgatccaatacctacctcagcatttacaggcagaggcgttggcgaagatgaaggaaatcgaccagccggttgttcctacctttacggaaaaagcccaatcggtttcttctactccttggcaggctgccgtactgaagaagggggcattgaagctcgaaggtttatcataccagatgtatgatgccgccgattataagcagtatctggataactacctgcgtgcccactatggatgggctttggctgatataggcaagccgggactggataagtcgaaagccgtcagtgtttctctctccgcacagactatcaggcaggaggttcgtaaagagaagaaagggatacggacggtaagcgagctggtcttccaaaatgaaagtaaggtggataagcgggtacttcctgaaaagatgtatatagatgtattggactataagaacggaaagaaggcggaagttactttgacgataaaaggcaaacctgctgttcgcttgccggaagcctattggctgtcttttactacggatgatattctttccatcgttgctgagaaggtaggtgagcgtgtcgatctgttcgatgtggtagaaaaagggaatcgccagcagcatggtatcgaccgctatgtagatttgattacctctaacggaaccatccgtatatggagtgaagccgctttcctggttaatgtcggtgaagcgagaggtataaactattcattggaataccccgacaaaaagggcggcgttcattttaatctgagtaataatctttggaatacaaatttccgtatgtggaatgagggatcgttaacttatcgtttcacgatcgaaagaatagattaacgacgaataaacataagagtaatagacaatgaactatataaagaaaacaggatggcttgtttggggtttgattggttattttaccgctttctcacaaacgaagcctatctatcaggatgcaacaaaacctgtggaagagcgtatagaagatgctctgtctcgtatgactcaggaagagaaagtacgattgctacatgccaatggcggctatcgttcgtggggtgttccccgtttgggaataccggagaataacccgacggatggtcctaccggtatgcgtccggagttccgttgggaaagctggtcggatgcgaatgcgaataatgactattgtacggcgttcccgtcccttatctctctggctgccacttggaatccggacatgggtatcttgtatggaaagtcatacagtgaagaggcgttgtaccgtaataaaaacatcatattgggtccgggagtgaatatatgtcgtacacctctcaacgggcgtagcttcgagtatatgggggaagacccttacttgtcgtctcagatagcagtgtcgtatattcatggtgtccagtcaaatcatgtggcagcatgtgtgaagcattttgctgccaataaccaagaaactgaaaggtatagtgtcaattcgctggtcgacgagcgtacgttgcatgaaatctatttccctgccttcaaggctgccgtacaacaaggtcatgtgtggacagtgatgggagcctacaaccggttgaatggtcagcattgttgccataacgactatttgttgaacgacatattgaaaaaggaatggggcttcgacggagtgttgttgtctgactttggcggaactcacagtactcaagaagcaatccttaatgggttggatctggagtatggaacagcattaggatctgaagaggcttttgaaaactattacttgggaaatgcttatctgcaactgttgaagtcgggaaaggctgacgaaaaagtattgaatgagaaggttagacgtgttttacgcatgatgtaccgtaccaatatgtcgccgaaccgtccttggggtgttatgaataaccgggagcatacggatgctgcgcgccggattgccgaagagggaatcgtattgttgaagaatgaagcctctatcctgcctttgagtctttcaggtttgaaaaagatagtagtggtaggcgagaatgccatacgtactgtaaccaatggaggtggatcttccgaagtgaaggctttgtatgaagtgactcctttggaggggataaagaacatggcgggcgataagatagaggtcgtttatcagcccggttattcatccaggttgaaaggagcatctgctgatagcctgaagcgggaggcgctaaaagcggtagctggtgcagatgtggttgtttatgtcggtgggttgaataaggaaccgaaccaagatagtgaaggttcagacaggttatcgtataatttgccgtatgggcaggatgaattgatagcggagttatcgaaagccaacccacatttggttgccgtgatgataagcggcaatgcgtatgctataccttggttgaaacaggtacccggtatacttcaggcttggtatggaggtacagaaagtgggaatgccatcgcttcggtattgtttggcaaaacaaatccttcgggtaagttgccggtaacttttcctgtccggcttgacgatgtggcagcacatgcattaggagcttatcccggagacggaaagacggtcgaatacaaagagggtatttttgtcggttaccggtgggctgaaaaagaaaagatcaaacccaactttgcttttgggcatggcttgagttacacgacattcaagtatgggaatgtaacggttgataagaaggtcgtggatgcgacaggacgtttaactgtaacggtacctgttacgaatacaggggcgcgagaaggatcagaggtggttcagttgtatgtcagcgacctgaaatcttccttgcctcgtccggtaaaggagttgaaagggttctgcaaggtccaattggctccgggcgaaaccgtccatgtatcgtttacaattgataaagaagcactgagtttttatgacccggcacagcatggctgggtggttgaacccggcaagttccaggtgctggtcggctcggcatcggatgatgtcagggcgaaaactatgtttgagttgcaataaaatatagttttatggataagaaaagtatattttgtggattgttgtctctgcttccctttctggcaaaaggagaggtggcggaagaatacaatactaaggtgaaagaggtcattgtgatctgtaagacccattttgacattggctatacgcaccgggtggatgatgtggtgaactattatcaaacggacatgatcgaccgtgccattaaagcgatggatgcttgtgtcgatctgcccgaagaacagcagtttgcctggacgatccccggatgggtattatcgaagacgatggaagactgggatgggcagactcctctacgcaggcagatattggacgaaaagttcaggtcggggaagatcatatcgcatgcgttacctttcacgctgatctctgatatttgcggagtggaggatatggtacgcggattgggcttttcgtctgcgttgaaccgtaagtatggtctgcctttgtcacactccggcaagatgaccgacgaaccgtcgcagacaggagccttggcgacggtattggctcatgcgggtatccgatttttgcatatcggttgtaactggccgagcgggtttgttaaaacaccgggattgttttggtgggaaggacctgatggctcgcgggtgatgacattgtactctgccagttacggaacaaactgtgccgtgtgtcctgtagaatggcagggaccgaatgatccgatgatgggagtaaacctgatgccggcaaaagattggccttatacggtttggccggctattctggtgacaggtgataactcgggacctcctacggcagaacgaattaaggaattgtttcaggagataaaagagaaaatgccggatgtgaatgtgcacatgggaacgatggatgacttttacgatgccatcatgaaggaaaatccgcaattgcccgtggtgaagtctgctatgccggatacttggatacatggggtgatgtgtgacccgggtggaatacgcctgttgcgggaaacgcattcattgataccggcagcagaggcgttgcatacgcaattgggctgttggggcgttgagacaccggctgtttcggatgagatagctacagcgtatgaaaagatggctttgtatggcgaacatacgtggggcggatcaagacaagtggatgtttacggaaaggcttttcagcaattaccggctgaaaaaaataaagatttggaagcttcgtgggaagataaaacggattatgtgcggaaagcttccgacatcgcgcattcggttacagataggaacatgaagtctttggctactcacgtgaaatgcaacaaaccctcttccattgtctacaacccgctaccttggaagcgttcggattggatagaggtggaaggaaagaaacagttcgtaaagaatatccccgcaggaggataccgaactgtcccgttgaaagaggtaagtaccaaagaacagagattgtcaggcaacacgcttgagaatgcctattataaaatcacttttgatgcggaacggggatgtatcacttccttggtagataagaagagcgggcgcgagtggatagacccgaaagccgaacggggcttcggacagtatctgaatgagcggttcacgtatgaacaaacgttggattatacgatgacttaccagcaggggcgtgcgaaggattgggcacatccgggtatctgcaaaccgggtatggtgtcggaaaaggaggtgccttatcgggcggcttcacccaagcaaggtgtgttgaagatgactgctgagggtgacgtgcaaatagccgaactgactatgccttccgaccgctccaaccatcttccggcttccgtattgcgcatctctttgtataaagaccagccgtatgtggatatggaaatcacaatacaggataaagcgaaagacaattggccggaagcggactggctctgcctgcctttccggattgatcaaccggagttcaaggtttatcggcagttgggcgtgatgaatccggcaaccgacattcttcccggagcaaaccgtcatttatatacggcagaacatggtgtaaccattaccggtcgggatggagctggaattgcggtatgtccgctcgatcatccgttgatcagtttgggagttcccggatgttggaaatattcagacgattacgtaccggaacagccggttgtctatcttaatttgtttaataatcagtggaatactaatttccgttattggtatcctggtacgtggagttcccgggttcgtatctggacggtagaagaaggtactactccggaagaaagatcccagctgttcgtgacttcggcattggaagcgcgtaatccattacaaactatatctgtaaagaagaatgaaggaaatcttcctgttgcccaatcgggtatagaagtctctcgtccgggagtgacagtcaccgcatttggtgccgatccggatggaaatacaggaacattactacgcgtttgggaacaggttggagtttcaggaaaactaatggtcacattgccaaagggtatggatgcctcacttgccataccggtaaatttgcgcggggaaaagaaaggagaccccatccacattaaatccggaaagtttgaactggaattgggagcttatgcaccggccagttttatattggatttttcggacttttgagattcaggactatagtgttgtctaataggacactatagtcctgattgtattatcactactgtgctaaggggaggcagactatagtgtcattacaataaaaagccaccgatgaggaaatactgactttaaacttgatctcttaatgtttttagtacataaagaggggggctgggatattttgtatatctttatcccccgttagcgatattgttatgaaggagagcaccgagatacaaacatttaatcacctgtttacaaactacaaaggacgttttattcactttgccaggacgtatgtggatgacgagatgatggctgaagatatagccgtcgaaagcctgatgtactattgggaaaatcgtcggaaactcgatacccataccaatgtgccggcatatatattgaccgttatcaagcataaatgtctggaccatttgcggcaattgcgcgtccaggaagattatgaggaatatgtgaaaacgaacgaggcccgtaagttgaacatccgtatcactactttggaagcttgcaaccccgaacggatcttttcaaaagaactacaggagttggttgataaggcattgttgtctcttcccccacaaacccgagatatttttacaaggagccgctatcatagccagagtcataaagagatagccgatgcattgggcatctctactaaagctgtggagtttcatattaccaaagcattgaaggtgcttcgtgttgcattgaaagattatttacctgcattgtttttctttggtatttgttagtagaccgatctttttcccttttaatgaatatttatttcaaaaaagttcacttttccgttagggatgtttccggctggaacgctttatatatagaacgatgaaaaagatgcaaaaagaaacattatataaatactttgaaggtatcgcttctccggaagaagaagaggctgtttaccgttggttggatgcctcttctgaaaacgaagaagagttgctgaaggagcgtgagttcttcgatgcaatgatctttgccggaagtgcggatgaaaggacagaaggaaagaagctggcattgaatgtgaacaaaggaccgtttattcgtccctggatgcgcgaagtactgaaagtagcagccgttgtggcagtgacggtagcttgtggactatacttctatgtgtcagaaaagaaagaactgttggctgcaatgaatacgataacggttccggcaggacaacgggtaaaccttacattatcggatggaacgacagtttggttgaatgcccgttcagagatggtttatccggcagttttctccggagcgaaacgtgaggtgaagctggatggtgaaggatacttcgaagtaaaacatgataaggaatctcctttcgtggttcatacccgaaaatgtgatatcgaagtattggggacaaagtttaatgtggaagcctattcggattcggaagagttttcaacttcattgatggagggatctgttaaagtgacggataattcagctgtctcagcttcggtccttttgaaaccggatcaggaggttcatttgaaagatggccggttattagtttcatccattgatgattatgatcatttccgttggcgtgatggattggtttgttttgacaatatcgtttttcatgagttgatgaaacgttttgaaaaatgttacggtatctctattgttgtggagaataagaatctggaaggatattcgtgcagcggtaaattccgtatttccgacggactggacaatgcgttacgaattttgcagcggaatgctaaatatacctttgaacgaaatgaagacaactcgattgtctatataaaataagtctaattaaaaatgaaacagcctatgaagcatgaatcgtaaagttaatcttaaagaagaaagttaatcttaaaatgaaatgccgacaagtgtccccacacccatcggcatccaattaacacagttaaaaataaatgtattaatcaattagcaacaacaaagatatgaataaaaaattcttatcgtgggttttctatgacaaaacccaacggtgtaaacacttttttagaatcatgaagctaaccacagtgtgctcattagcattgacattcagtctacatgctggaaatgtagattctcaaaatgtcaaagtgacggtgaaacaaaacaatacggaactatccagtgtcctgacagatattgaaaagcaaacggattatttgtttgtatatgataagtacgtgaatgtgaaccggaaagtgacggttaattcgagtaagaagtctttggaggagctgttaaaacagctattcgatgggacggatgtgaagtttacggtagatgggacgtatatcattttatctcccaatagtaaattagaaaatactgtacttgcggttgcccagcagaaccgtcaggtaacaggggttgtaaaagacgaaacaggagagccggttattggtgcgaatgttgtggaaaagggaacaacgaatggtactatcacagatgtcgaagggaggttctcccttaacgttgcgtctgacaacgcaacgttggtagtttcgtatattggatatgtttcaacggaaatggtagtgaaaggacaatcgtctgtaaatgtaacattgaaagaggatagtgagacattggaagaagtggtggtggtcgcgtatggaacacaaaagagatctaatttaacgggttctgtagatgtagtaagttcaaaagagttagcaaatcgtccggtgaccaatactagttctatgttacaagggaaagctagtagtatcactttctctactccttctggaggaaatactcccggtaaaactccaacgattcagattcgtgggcaggcagctttgaatgagtcgactcctcctcttgttgttattgatggaatcccttccagtatggatgattttaatgctttaaatcccaatgatgttgaaagtatttcagttttaaaagatgctgcagcttctgccatgtatggggcacgtgctccgtatggagtattgatggtaacgacaaaaatgggaagaaggaatgagaagccttctattacttatagtggtaattatggtgtagtaactcctattaatatgccaagaatggctgattcatatactttcggattattgaagaatcagtcgaaagtcaatgctaagatgcctgtggcttttacaaacgatcagttggatcttattttagataatatccagaatccaggaaagtatactttatcggatttagtttctgatgaaggtaatacttggggatggggtaatcagtcttattgtaataatgattttattgatatttggttacgttcttcgtttcgtcatcaacatgatctttccgtgagaggtggtaatgataagacttcttattctgtgtctacggggtatgtctatcaaccgggcatcttgaattttgtagaagatatagataattattctcgcttcaatattaatgggggagtggaaacagatgtcacttcttggttgaagttgacttatcggtctcgttattcatatgaaacaaccaaggatcctaattttgagtatggacagggaagatcacgtgcttatgagtttgcttacggagcgtggcctgttactcctgttaaaaatccggatggagtttataatgaaggaacccgtattgcaacaggtataggagggggacatcagacaaccgtgtatcaccgtttggataatattttagcattggattttaatctggccaaaggatggacagctcatgtggatggtacttggcgtatgaactttaaagattatcagtctttgaagatgcctgtttacggattaagaccttccggggataagttccttatgggaggtactgagtcgtcattggcaaagcatacaggaatgaatagatattggacgatacaagggtatacagcttatgagcatcagataaaaaagcataatttcaggattcagttaggtgctcagactgaggagaatacttatagagaattgtctggaacagcaaaagatttatttgttccggatatggatgctgtttcaattgcgcaaggtatacgaacattcgatgataaaataaatgattgggctacttgtggcttttttggacgtatcaactataattttgatgaacgttattttatcgaactaaatgggcgttatgatggatccggtaggtattcgaaaggttctcaatggggatttttcccttctgcttttgctgcttggaatatgagtaatgaaagtttttgggaaggtcttaaagatgtgatcaattttgcgaaattaaaaacatcttatggtacattgggaaatcaaggtaattctgcaggttatttacatataccgaccatggaagttgcttcagaatcaagctggattttcaatggaagtagattaccttatgttaagactccgggtattttaaatatgagcaggacttgggagaaaattacgacattggatgttggattagagatgagagcattggatagtcggttgtctgcagagttaggttatttcaatagacgttcgtgggatattattggacctcctacacctaaagcagcagttcttgggacaagtgctccttcgataaataatgcagaatttgtgacgaatggttttgaaatgcagttaagttggagagatcaaattaacgagcaatgggattacggtgtttctttaaatttagcagatgctcgcagtaaagtaacaaagtataattctgcatctaattcatttggacaaaattcggatggttcagaaaaatggtatgaaggaaaagtctttggtgaaatatggggatataaggttaatagattcctgaccaaagatgattttgatgaaaatggaaagttgttagttgatcaaagtaagatccatgccaattggtatccgggtgatgttaaatatgaagacctgaatggagatggagagataacccccggcaactctacagtagaggaacctggtgataaacggatcattggtaatacgactcctcggttcagatatggtataaatttgtctactggatatgagtttgagaaagcgggacgtttggatttgtcgcttttcttcgaaggtgttgcgaaacgtgatctctttatgaatggttctttctttttctggggaacaggcgttggtaattcatttgctagttctgtatatgataataaatggcacatggatttttatcgggatggtacaacggattcacgtttgttggaatatatgggtgaaaatatcaattcatattttccacgtccttatgataatgcggaaggaaacaagaactttcaaacaaatacgaaatatttgctaaatggagcttatctaagattgaaaaatcttcaattggcttatacattacctaaacacctgatttcaaaagcaggaataactaattgcagagtttatttttctggagaaaatatgtttgtgttatcggctttaccttcttatatagatccggaagcggtaggtggaggaagaatgtatccgcaacaagctgtttattcttttggagttaatgttagtttttaatgaatataagatatgaaaaatatatataataaaataaaagcaacgtacaaagattttttagttttaccaatacttgtggccttattctcttgtgatgactttttggatagagaacctttggatgaagtttctcaggttactttttggaaaacccccgaacaattagatgcttatattgtaggaaaatatgaatggcttcccgggagtttaacggattggggaatgggatattatatcgatgaccagaattcggataatatggtgatcggtttgaatcatcctacttggatgaatggagaagataatacgacaccaacaagcggcggtgaatggaaatggggacctattcgagaaattaatatgttcttcgataattatgttctatgtgaatctccatttagtgaatatgagcatacttatggggaagcttgttttttgaaggctttgaagtatcatgaactagttcggaaatttggagatgtaccttggtattcttcggttatttccgattcagatgaggaagcattgaataaagctcgtgatccacgttctttggttgtcgattcaataatgaatttgatggatcaggctgttgaacatttgaaattgagaacagacgttggtgtcaataggcttaacaaagagactgcactgatatttaagtcgagaattgctctatttgaagcaacttgggctaaatatcatgaaggaacaaagtcggcttcggatgttgatgctgataaactttttcaaaagacaatcgaagcgtatgaccagtttaaacaaatgtgtggaggatttgaaggtaaactttattcaaccggacatccggaatcggactattataatttgtttaatagatttgattatgctgatattcaggaagtaactcttagtaaaaaatattcagaagcattgggtataaaaaataatgttaatgtacagtcttggtggtatggatattctaattgctcttatacgttagatttggttcgtagttatttatcgaatgagggaaaatctattgatattatggataagtcggctgttccgggaacgggggttgtctatttatctgaattggcatcaaaattggatcctcgttataagcaaagtgtgtttactccaggggatttgttgaatactgttactcctggttttatagattcattgtttactgttcctcaaatacacatctctgaagcgggtcgtaacacgactactggatttgctccaaagaaagcacataatgtggaaggacctcttataaatcaatcagatcctttggtttctggtatttcgtttagagttgcagagttgatgttaaattacgtagaagcttatgttgaattaaacggttcgtttcctgatttgtcggataatatagatttgctgcgtaaacgtgttgggatgccagctttgacagaggttaaaccgcaggttgagtcatggtggcctgattatggttatccgatttctgataatttggcgattgttcgtcaagaacgaagagttgaattggctggtgagggatatcgtacagatgattggaagcggtggagagctcataaattatttgacggaaaacgtcctaaggggtatcggtatgaaaaagaagattatgtaaaacaaggattgaatattccgtcaatacctgttgataaagatggttatttagatccgtatgtaattagtttgaatggaggtacatttaagtttaatccggatagggattatttaagtccgattccaatggatgaactgcttattaacccgaatttgaaacaaaatccggggtgggattctccacaataaaagaggttcttattattgagaaggtgtgccaaaaacgattaccgaacgtaggaaacgtagaaaatacagatctgtttttgacacaccttcattgattattctattttttcaaatagcaataccatgaattttgataaaagaaactattttgtagccttaggcgcattgatttcctatacagcttgtggggttacaaagaatcccaatgtaatttttattttggcagatgacattgggtatgccgattttggttgctatggagccaaaaaaataaagactcccaatttagataagttagctcgtaatggagtaagatttaccaatgcttacgctccggcatcaacatcaactccttcgcgttatgctttacttaccggagagtatgcttggcgggtaggtgctcatattctgccgggagatgcacctttattgatagatacacagaaaaataacttacctaaaacatttcagcaggccggatataatactggcattgtcggtaaatggcatttgggattggggagtaaagaggataaagtgaattttaataaaacgatagtcaatggtcccaaggaggttggttttgattattcatatatatttccagcaaccaatgaccgtgtgccttgtgtgtatattgaaaatagtaaagtggtaaatttctcttcttctgaccccatacaggtttcttattggcaaaaggtgggaaataatccaacggggaaagagaatccggaattactgactttgcgacctcacatgggacacgacggaacgattgtgaatggagtgagcaggatcggttggatgagtggtggaaatgcagctttatggaaagatgaagagatggctgatactttattggacaaagctttacaatttattaaagagcaaaagaatgatccttacttcctcttttttgctactcataatgcacatgaaccacgaattccttctccaaaattcagaggaaagtcgaaggcgggtatttatggtgatgtgattgaagaatttgattatatggtaggggaggttataaaggttctgaaagaaaaaggagaattggataataccatacttattgtaaccagcgataatggaccgcgaatcagggaagggtatgcagatggtgctttggagaatttgaacggacataatccttttagtatattcaggggtgaaaaaggaacattgaacgaaggtggaattcgtgtcccttttatttttagttggccacaaaaggttagaaaaagctttgaacaagaacaacctgtctgctatatagatatgttggctacattttcccggatattgggtaatcatacaagtggtccggatatgaatgatagccgggatgcatctgaactattttttgatcctcggtcaaagccatatcgtccttattttattttgcaggataatggtggaaacatcgctgttcgttctggcgaatggaagtggattcctgcgcagagaaatcaaaaccaggaattgtataatttgaagaatgacccgtcggagctacataatgtccaatttgattattggatggttgtggaagattttggacgaaaagtgtcggaagtgtcacaaatgaataagaaaaaataagtggggaagacatgagttctttcttggtatccattaaagtaatataatacgaaaaactaccttttatagaatgaaaaatatagttttatcaatactaatactatggtttataaatcccggagtatatgccgaccaagttgtctacttgtctcctacgggtagtgacgatgggaaagggacggttgaatccccttattattcactgaataaagcgatagaagggcagttggataaccggagtgaaacggatactttgtttataaaggtggcaacaggcaactattatatggatcgtccttttgttattgatcgaccgtcttctcgtccgattatcatccaatcggacggagacgtaggtaaaccttgtttcataggtggtgtgtctgttaagggttggcaaaaatatggagataagttataccgggcttatgtgccggaggtgacccgttatggattggagtttgagcaattatatgtaaatggaaagcgggcaattctggcccgtactcccaatacggactggtattatgtaaaaagttcttccgagactccctttgtggaggatgtccgctttgctgattatgccgttcagcggattaatctcaatcaggaagactggcaggagatgagtaaactacaactttccgatttgcaacagttgaaattccggttttatcacaaatgggatatcactcataaacgtgcggcctatgtggatgtcgattcagcttttatttatgtgaatgggaaggggatgcatccctggaaccagatacgggaaggttcccgctatttgatgtatgattatatggaagcgttggatacaccgggcgaatggtatcttgacaggaatacgggatatctgtattatatgccttatgaaggggagaacatggaaactgccgagtcctttgtaccttcgcttgaacagctggttgtgtttaaaggggaagccggaagtccggtgaaacatgtgacatttgaaaacatctcttttcaatatagttcctatcgaatgccggaacatggagaagagcctatgcaggcggctgcctttactaaagctgcgttatcatttgatttctccgaatatatatctttgatcaattgcgaaataggtcataccggaacttacgctgtctggttcaggcaagagtgtcacaataataaagtggaacattgttacctggctgatttgggtgctggtggtattaaaattggcgaaccttatttcaggtcagataatcgtaaggtcaccagccataatgtgatacataataatattataacgcatgtcggacgtgaattgcccagcggtattggagttgctatctttcacagtagcgataatcaagtgactcataacgagatttccgatctatactattccggcgtttctgtcggttgggtgtggggatataatgactctccggatctttggacacatcatctcaattctaggggagaagctgagttttaccaggcaaaactgaaaagtccggctgtcaggaatatcatctcatataaccatatccatcatatcggctggggagaactgtcggatatgggagctgtttatacgctcggcgaatcggaaggaacgaaggtgacatataatgtcatacacgatgtcttgtcttacgactatggcggctggggactttatacagatgaaggttctaccggtgtggagatgagcaacaatttggtatatcggtgtaaaagcggtggcttccaccagcattacggcaaggataataagatagagaacaatatctttgctttcggtcattattatcaggcacaatacactcgtgcagaatcacatctgtcattccatttcaagcacaatatcatcttacataatcagggagaaacattggctggtgtctgggagactggtttgttggatattgattctaatctgtattggcatttgaacggtgaacctaagtttggcaaatatgcattcaaagaatggaagaagctgaaagaacctcattccgtctatgccgaccctctgtttaaggcccctttatcggatgattataccctgttgtcttcaaaggctgtccggaaaataggattcaagccttttgattattcgaaagcgggtgtctacggagaaaaaaactgggtggagaaggcctgcctgagtccgcagacgttggatgattttcaacagaaaagtcgggaacgattgaagaaataacaagatacaaacactttataagaaacagaatgaataaacgaattctatcaggagcctttctgattgctttattgggaatgtgctcatcatgtacaaataacgactatacgttatcctcacctgacggcaacctggttatgcaactccatccgaatgaggagggagagtggacttattcttttcaggcggaaggtactccgctcatcaacgaatctgaattgggatttgacctggttggtggcgatgacataccgggcgaaggctggaaagtcaatgatgtctccaagagagaagtgcgcgatgtatggaaaccgatatggggaaaacgtacggaggttgatgaccatttcaatgaagtggtccttgaattgagccgcaaaggtgctttccccgaaaagatcaccttggtggcacgtgcctacaacgacggcgtagctttccaataccgtattcccgaagacacggcgggagaggccaaggtggaatcggaagaaacctcctataactttgccggcgattatacggcatggtattacaacggtgagtatcacaatctcggtccggagaaattgacggaaaccggagaggaacgattgcctgtaatgatgatccaagccggcgaccgccattttatggctatccatgaggcagacttgcgtatgggcgaaccgcttcggttgaagtcggagaaagggaaaacggaatttaccgtggcttccaaaccgtctgccttggttcccggatatgcctccgcctggcgtgtcatcatgcatggcaaccagccgggtgaactggtcgactcgcatttaatagaacttctcaaccccgacccggatccctcgtatgacttttcctgggtgaaaccgagcgtcgccttgtgggattggcgtatcgacggtgcggaatgggaaggttttaaatatacgatgtcttacccttcctggattcggatggtagacttcgcagttgagcaagacttcaaatacctggtgctggatgccaactggtacggtcctgagtttgagtcggattccgacccgacgaagggagacaaggcacgcgatgtgcaaaagctgattgcatacggcactgaaaagggcgtaggcatctggctgtatctgaatgatgtgggaggacgcaagtaccctatcgaggagacattgaaacaatatggtgaatggggtgctgccggtgtgaaatacggatttatgagtggaacacaggaggagaaaaaccatcgtacacggatgataaccgaactatgtgcgcaaaatcatctgctggtggattatcacgacggtcctgttcatccctacgggcagatgcgtacttggccgaacgctgtcacgcgcgaatacaattttgcccagttggatgctcaccgcgtgttcgaaccgaagaccttcgtcacttccgtattcgtcaatatggtggccgggccgttggatatgaacaacggtatgtttgacttgcgccagggacctaccacccgcgtggacaataatcaggaatgtccttcgaccgtcgtatctgaggcggctcgcaccttgataaccttctccggtgccactattcttccggatatccctgagtattataagaaatatccggagttactcgatttcatctcttcccagaagatgccttggaaggagagtcgtacattgcaaggtgtaattggcgaatacattgtcatgatgcgtcagacggaggaggcttatctggtaggcgcagccacgaatgaatccggtcgtactatcaacctgtcgcttgattttctggctgaaggtaactattgggctgagattgtggaggatggagataatgggcattatcaaaacaatcgggaaacgtataaagcttcgaagaaagaggtgaccagtaaggatacgattacgcttacgttggcaccaggcggaggcgcttgtttgaaaattacaaagagaaagtaaaaaacttcatcatgagaaacttattaattattacaggtttatggatggcatcggtattttcgttgagtagtgcctatgctataggggatatcaaacctttggtaagatatcatcaaaataataaagtagtggcttctacctcttttgaggagaagggaacttcgatagtaacagactccaaagggtgtcagtgggtattgagaacagataaacaaccggttccaggcgacaaaacagcacttgattatacttttacctgggagttgaaaaaagggatggcggagaatgtctcgtttgccgtagattttgaaatggacgagtggacgccggataattatgtctttgtccctgctatcgtttatgacgggaaccggtttgctaccaaggatatcggttatcctcctttttggtatgataaagccgagtggcgtgtggatatgcctacgactgtcacctcttctcaacctacattgggcaggaaaggcgaaccgtctaaaccgattgagttgacttccggtaatgcatccactcctttgatggcttacttctcggaaaaggatcgtaaggcttggatggtgcagaccaaccagggaaatgatttaggcgattatggtttgaccataatggaaaatgaagatcgttcggaggctactttttctatcacggctcctgttacacgtactggcaatggagctgatattccggcaaccctgaaagagggagaaagagtgtctatctcttgtcgcgtgtacgactttaaagcaaaacggttgaatgatatgatggatcgttttgtagaggttcgtaaggagttcaataagagtgaacgtcatgacgtggtgccttatagccatttgtggacgttgatgaacaatctgtaccaaactcgccgctgggatgatcgtatcaatatgtattggttgagtgatgtaaaagataaagcaagctggaatttcatttggcaactggggtggtgcggaggtggccaggctacttatcctatccttttgaggggaactgattcagataaggaacgtgccatgaagaacctggatgctatttatgatcgcacgcaagccaagtccggtttcttttatgcctatggcgatggcaaagagttctatggatttgggtacgggaagccattggaagataatgtaacatttgttcgttcgcaaggtgactggttataccttgcgcaattacagatgaatctgctgaagtcgagggatgaacaggtaaaagtttcttggaaggaaggtacgcgtaaacaggcggatgcctttgtccgtctatgggataaatatggtcagttcggtcagttcgtagatgtggagactggtgatatttgtataggcaattcatgcgcaggggctattgttcctgccggtttggctatggcggctaagacctataataacccgcactacctggaggttgccacattagcgggacgatggttctatgacgagtatgtcaagaagggttacactaccgggggaccgggtgagattttgtcaacaccggatagtgaatcggcttttgctttgttcgaatcttttatggtgctttatgaagagacggggaataaagagtggttgaactatgcagcagaattgttaccggtttgtgccagttggacagtctcttacgactttcactttcctaaaggatcagctatggagaaagcgggtgctcatgctaccggtgcggtttgggctagtgtagccaacaaacatggtgcacctggtatctgtacttggtccggacatagtttgttgaaatattatcgtgcgacggcagacaggcgtgcgcttgatttgttggaagacatagctcatggattacctcaatatgtcagtcgccaggaatgtccgatcggttccatgccttggggaggaatgtgtgagcgtgtcaatttgagtgattgggaaggtaaaagtggagttggcggcaatatttttgcctcttgctcttggtgtgaagttggtgccttgttgacagttacccagattccaagtatttatgtacaaacagaccgacaggaggtaactgtattcgaccacctgaaggttgaaaagaagcagggaggcgatggccgtatagtattgaaaataaccaaccccacgacttactctgccgatgtacggattttagcggaaacttccgaagaagcacgcagcgtattgatgccggcttccgtgaatgagctggagtctctctccctgaatccgggagagactaaagaaattaatctctgaaatacttatgttataacttgaaattctgctttctgaactctagtggagaaacccccatcacattggagaacgtacgggagaagtattgagactctttaaagccaagcttgtgagcgatctgattcaccttcatatctgtttggatcaggagcttgcaggctttgtctattttcaggcggatgaaatagtccattgggggatgtccgatctctttgacaaatttgcgatagaaataggattccgaataaccgcagaagttggcaaagtccgtaattttcaggttcgattcgatattatcattcatgaaatgtaccacacggttgattatgttttccgaatactccttttgccggaagcggttacggtagatatcgatgaaaaggaacgatcccaggaaatgggcaaaacatagattggcataatgcatatgatccatgtccgtactctcattcagagtgttgaacatctcttcgaacaaatcgatccgttcctctatccgcgactgtgcagagggagggaccgatgtcggcttatcgaaacgggaggagaaaagaggcgctttgcttcctctgaaatgtaaccagtaaatagtccagggatcttcttcgtctgctccgtaagcatgcggaatgtggcgtggaagtatgatgaattgattagcctccagtattttccgttttccgtataattcgacccatccccgtccgtccttgcaataaatgaacagatattcgtcacatccttcgggacggtttatataatggtgggaagcacgcgcaaaaaagcccatggaataaagatacaggtcgcctgtgaggggactatcttccatcagattgatcatagggatcggcagatagatgaaacgttcgccggaaaaaccaagttctacttttgccataatacatgtaatcggattgacactgtaaagtaagcaataataatccacggaataagcaattatttgctatttattattgaaattgtagtttctaattttgcttaaacttacactttaccttatacctcgtcgcagtaatggtgaagtaaacagaatatcgcaagattgtataagtaaacaatcggaatgtctattgaataggaagtaaaagctcttttattttgtatgatgtgtaaatagttaatctaaatgtaatagaatgagaaagaaaatagtgttcagcttattgatagttgtgttttcctccatggttcaggcagatataaaacccggtgcaatcgattatatcgtacgcccgctttacggctacaggaccgatggggcacccggacgtattgtgacggtccggctgaaaggagaggaactgaaaggtgatctttcggtcgaagtgataaccaaagggaaaacggaaaagagtcattttgcattaaatgcgaaagattcgacagaggtagatgttctgttacccgccacagtacctacagggaggaagtcggaagtcacatttgtcctccgtggagcggataagacatacaagcaaaaagtcagcattaaccctatgcgtcactggaatgtctatctatataatcatgcccatgtggatataggttatacaaatacgcataagaacgtagagcagcttcataaaaacaatatcattgaaggaataaaactggcggaagagacgaaaaaccatcctgacggtgcccgttttgtctggaatccggaagtaggctggcctatggaacggttgtggcaatccaatccggagatgcgggatgaactggttgaggctatgaagaaagggcagatatgcctggatgccagttatctgaatctgaataccagtacctgtgccgatgaggaattgtttcatgtctttaagtttacccgcgagatgcaacggttgagcggagttccttcggatgttttccagcagttcgatataccgggtatgtcgtggggattgatcccggttatggcacaggagggtgttaagtatattatctcatggccgaacaccgaccgcgcaggaaatgctcataagaatatggatggaaaacccttctggtgggtaggtcccgacggtaaatcgaaagtcttgttccttcagccgggcggttatgccaatagcggcagtatgggaaaaggcggggagaccggacgtccctggtttggacaacgtgacccggcaaaagtgccgaaagtgattcgtatgggatatgccaatgtcgattttactgagaaactgatggcgttggaaaaagagaattatccgtatgattataccgttctttcctggtcgttgtgggataacaacccgcttgatgccgatgttccttttgcggtgaaagagtggaatgaaagatatgcttatccgaaaatcattatcagcggtggtcatgagatcatgtcgatgatagaagagaagtacggtgaccagctgccggttgtttccggtgactataccgaatactggacggacggtctgggtacggctgccggcttgacagccaagaaccggaatgccaaagagaaactggtgcaggcagaaacgatctggtctatgctggcggatggaggaaaagctccgcgtgaagatttcgatgaggcctggcgttatatccttttgggttcggaacatacctggtgctttgagaacccaaccgaaccctatttccaggatgccatctggaaagtgaaacagtcttacttccatgaagctgaagaccgttcgatcgatatgctggatgaatcgttggctcctgccacggataaatcgaatggggcactgggtcctaaggaaggtccggcaaacggaggtatcgccgtctttaatacacattcatggccgcagagcggtgtgatccggctgacggcaaaggaaagcctgaaaggggataaagtggtcgaccagaatggtaaagagcttctttcccaacgtctttctaccggtgagttgttggtcaatgtgccggaagtacctgctctgagttcccgtcattttcgggtagtggaaggtaaatgttctttgtcgggcagttgcaaaatagaaggaacgacactggagaacgattgtctgacggttcatgtggaccggacaaccggtaatattgtttctttattgaagaaaggttctgaatataactatattgcccagggagccaataccttctcctggttaccggcgaatgtggatgctccgcaggcggatacggtattgtctgtttccgtagtcgaagaaggtcctttggccgtagaactgtgtgtgacatcgaaagcaaccggttgccggagtgtctcccgttctgtccgtttgcaggcagggcagccgtgggtggaaatctccaatgttgtagataaattgcctttggtggagaaagacggtattcattttggctttgccttcaatcttccgaattcaaagacccgcgtagatattccgtggggtgtgatggaagtggagaaagaccagtggccgcaaggtaaccgtaactggctggcgatgcagcgatggcttgatgtctcgaatgccacacatggcgtaacctggtgttcgctggatgctcctttgtttgaatacggcgatcgttatgccaatatcgcaatgggttggggaggtcagggaaactggataaccaaacttgaccccggttcaacggtctattcatgggcgatgaataatcactggcataccaacttcccgttgacacaggatgggcctgtccggttccgttatcgtttgtatccgcacgaagcctacgatgtggtggaagccaaccgtttcggaatggaacagtcgcaaccgctggtatatgttacagccgacaaagatccgcaggtacagcctttgattgctatcgacaaccagaaggtttactcgacgatcatcaaatccctggaaacggatcatactttgattatccgtctccgttccttgtccgacaaagaggaaagtgtaaaactgtctttccctaaaaagaccccggcacgtgtctctgtctgtgatcgggaggagatagccggagaaagaaccgacggtaatctggtgatggctccgtacggacaaataacattgagattggaatattaagatgcaataataatccaccaaataggcagttttttgctattttatatcggaaaaggaccttctatatttgcattgtgcttacataagaagctacagtaacaataccatgaagagaaagcagtttctttttatactattctaaaatcaatattgaacatgacatctaaacagcgtgtgcaaagcgcactagcccatcgtatgcccgattgcgtaccggtcgacttcggagcaacttcagttaccggtatccattgtaaggtcgtagaggctttgcggcaacattatggattggatccgcatcctgtccgcgtcatcgaacctttccagatgctgggagagatagagagtgacctgcaggagattatcggtgtagattgtgtccccgttttcggacggaaggatatgttcgacatcgatgaaactcaacttcacgaacaaataaccccctggggacagaaagtgatgatcgcctccggtatcgacttgacgaccgacgatcagggagacgttcatatctatgcggctggcgaccgttcttatccccccagtgccgtgatgcctgctgactgctattttatcaatgcaaccgaacgtcaggagtatgtcgacgatgatgcgattcagccggaagataacctggaagaattcggtcccatttcagaagaagatcttcagtattataaggagacagtcgaaaaggctgccgccaccgggaaagcggtcgttgccagcttcggcggtacggcactgggcgatatcgctttcgttccgggtatgggactgaaagatccgaaaggtatccgtaatgtagctgagtggtatatgtctaccgccatgcgccgtgactatgtgcaaaccgtttttgaaaagcagaccgatatcgcgatagcaaattatcaacgcctttgggatgcagtgggtgaaaaagtcgatgttgtctttacctgcggaaccgatttcggtacacaggattctcaattctgctccctcgagactttcagggaattgtggcttccccactacaagagaatgaatgactggatccataaatataccacctggaaagttttcaaacactcttgtggggctatcatcccgattctcccaggtttgatagaggccggcttcgacattatcaatcccgtccagatcaatgcgaaagatatggacccgaaattcctgaagaaagagttcggcagccaggtgacgttctggggcggaggtatcgatacgcaacgtatcctgccgaatgcaacacccgaagaggtgcggagccatgtcatgcaggaatgtgagatactgggggcagacggcggtttcgtctttaatgccgtccataatatacaggccaacgcaccggtacggaatgtagtggcaatgatagagacattgcgtgagttacgaggttaaataataaaagaagaataaagttatggcagatttagataaattgtatgaagctattttgacaggaaaactgaatgtagccaaggaggtaaccaatgaggctatcgcagagaatatcgacccgcatttgatcattaataattatatgtcgcgggccatggaagacatcggtaaacgttttgaggaaggaaaagcctttgtccctgaactattaatggcagcccgtgccatgaaaggtgcgctcgacctgctgaaaccgcaaatgaaaggtgctgcttcccacagtcagggaaaagtggtgatcggaacggtgaaaggtgatttgcatgatatcggaaagaacctggtagcttccatgctcgaaggttgcggattcgaggtgatcaacctgggtaccgatatttcttcggaaaagttcatcaatgctttgaaagaaaaccaggcgcagatactttgcctttcagcgctgttgactacgacgatgaactatatgcaggaagttatcaaagctctggaagaaaacggtcttcgtagtcaggtaaaagtcatggttggcggcgcaccggtctctgaatcctttgcccgccagatcggggcagacggttatagcgacaatgccaatgctgcagtaacgcttgctaaatccttattatctgcctgatcgtatgcaggagtacgagttggatttcagcctgctatccctgacggcaaacgatttgtttgctgagatgggatatggcaatacgcagccggaagaacccgtagaggcattggccgtctctatgctggaagaggtttcgtcctggatcgttccgcgttgtacgttcggattgtttgacggcaggattgaaggaaatactgttttcatgactggtggcgagagctttctagtgggagcaacgatctctttccttctgaaaggctcccggcacttcgccctctttgcggcaactgccggcactgcttttcaggaataccagaaccgtttgaaaacagaagatgatatcctgaaaagttttattgccgacattatcggaacctgtgtcgcagaaaaagccggcgactacatggaacggttactcgaaaaagagctggcaggagaacgacacacgaaccgtctgagtccgggctattgcggctggcatttgtccggtcagcagaccttgttccggctgatgggcggaaccccttgcggtatcagcttgtctgaagtctgcctgatgacaccgatcaagtcgatcagcggtattatcggcatcggacctgatgtggatgagaaaaagtacggttgccagtattgtgaactggaaacctgttataaacgaaaaagaaagaagaaataatggaaatacagaaatggttgcaggaaacaatgagccggcaggaacgaagggctgttcctatcatgacacatcccggtatcgaactatgcggtaaaacggtaaaagatgcagtttccagcggtgaagtacatgcagaggctatctgccggttgaacgaacaatatccggcggcagctccgacggtcatcatggatttgacggtagaggccgaagccttcggggcgaaggtggttttcccggaagatgaagtccccagcgtaacggaaccgttggtatcagacaaggagtccatagataatctgcagatcccctcgctggatgccggacgtgtacccgaatacctgaaagcaaaccgcctgacggctgagcgggtgaagggtaagcccgtctttgccggttgtatcggtccgttttcgttggcaggacgtttgttcggtttgtccgaattgatgattgccctgtatgtggaaccggagaatattgccgtcttgctcgaaaagtgtacccgttttctgatcgactatacccgtgcgatcaaacagacgggcgttcatggcgtgatcatggctgaaccggcagcaggtctgatctcaaacgaagattgtatcttgtattcgacgaattatgtccgtcagatcgtggatgcggtgcaggatgaaaactttatggtgatcctgcataactgcggaaactccggacattgtacggaagccatggttcagtcgggaactgtcggacttcatttcggtaataaaatagatatggcagatgcgttggctaactgtccggaagaccggttggttatgggtaacctggacccggtcggacttttcaaacaggcatcgtcagaacaagtatatgcagagacgatgactctcttaaagaataccagccagtggaagaatttcgttttatcgacaggttgtgatgtcccccctcatattccttctgagaatatcgaggcgttttatcaggcacttaatgattttaacaaccgatcaatgtaaaaaagaatgtcctgtgtaagttctttacacaggacattgtatttagaatcgtatttatctgtttcttaccggataaataacagttcccggtatttcggcaacggccacatctggttatccaccatcagttccagttcgtcgatatgctcgcggatatcgtccaggaacggaacaaccgtatcatgataagcgatcgccttgctacgaaggtcggttatgacgtttgctttcttacgggcttcgatcatttcgtccgtcatgcgtgttacggcatttacgtgtttggaaattttacgtaccaggcggcgcggttcggctgacaagtcttcgtattcttccggactgaatgtctctttcagcttggtgatattgctgagcagtaaagactggtaatgcaatacgactggaataatatggttcatcgacaggtcgcccaatacgcgggcttcgatctgtacctttttaatataaatttcccatttcacttcgttacgggcttccagttccttttcattcaatacgcctgtttccttgaacatgcggatcacttccggtttcaggtaagcatcgtattgtagtggaacgctgttttcgcaatccagtccgcgacgggcagcttctttcttccattcgtcgcagtaaccgttgccgtcgaaacggatcggtttggattctttgatatatgctttcagtgtttcgaagatagccacttctttgctctttccggcagcctggagtgtttctacatctttcttgaactgttgaagctgatgagcgactgccgagttgacagccagcatagccgagccgcagtttacggaagaacccggtgcacggaactcgaaacggtttcccgtgaaagcgaacggagaggtacggttgcggtcggtattatccaatagtaattccggtatctgtccgaagcccaggctcagacgtttcttgtcatctacctcgatcgcatcctcgatcgaactgttctcgaatttatccagtacttcgctgatctgcgttcccaggaaagaagatatgatagcgggaggcgcttcgttggctcccagacggtgtgcgttggtcgcagaagcgatacttgctttcaataaggcattatatttataaacggccatcagcgtattaacgacgaacgtgatgaaacgcaggttgtcttcgcggtctttacccggcgagaagaggttgatgcccgtatcggtacccatcgaccaattacaatgcttacccgaaccgttcacacccataaaaggcttttcgtgaagcagtacgcggaaattatgacggcgcgaaacacgtttcatgaccgacatcaacagttggttatggtcgttcgccaggttacattcttcatagatcggtgccaactcgaactggttcggggcaacctcgttatgacgggttttcaccgggatacccagcttgtaacattccacttccaggtctttcatgaattcctgtacgcgtgaagggatagcaccgaaataatggtcgtccaactgctgattcttggcactttcgtgtccgagaagcgtgcgttctgtcagtgacaggtcgggacgggccgaatacaattcttcgtctaccaggaaatattcctgttcccagcccaggtaggtgatcactttatgaacatcttcgttaaagtagttgcagacctctttggctgctttgttcagagcttcaaccgagcggataagcggtgttttgtagtcgagcgcttcaccggtataagcgataaatacagtcgggatacacaaggtgtcgtctacaataaatgcgggagaggaggggtcccaggcagaatatccgcgggcttcgaacgtgttgcgcaatccgccgttagggaaactggatgcgtccggttcctgctgggcgagcagtttgccgctgaattcttcgatcataccgccattgccgtcgtgttctacaaaagcgtcgtgcttttcggcagttccgtcggtaagcggttggaaccagtgtgtgtaatgggttactcctttttccagtgcccacatacgcataccggcagctacatggttggctatttcccggtcgataggtgttccattatcaatggcgtgggtcagggctttgtacgtttccttggagagatacttttgcatagccttacggttaaatacgttctcgccatagtactcggatactttctgtttgggagtgatggcttctacggccttacggttggaagctttctccactgcattaaagcgtgagattgacatacggattatttttttgttttaccggctgcaaagatacgggcaaatcttggtttgtgctttcaatgggtagttaaaaagaaacaaagcccatccgacttgggatgagcttcgattatccttttttagagtgcagtatgttaggactgagctagcaagggcactatcatggtgcaaagtgggggattcgtctccctgggttttcgttgttaagaatgtgaactgttctatcctatttgtctttaaaacaaactccacgccactgtcaaccccgccatcacaatggctaccatactcatcagtttgatcaggatattcaggctggggccggaggtatctttgaacggatcgcctaccgtgtcgcctacaactgttgctttatgggcttcgctgcctttgccgccgtggttgccttcttctacatgcttcttggcgttgtcccaggctccaccggcgtttgccatgaagatggccagtacaaatcctgtactcagaccgcctatcaacaggccgatcactccggtcacaccgaatatcagtccggttaatatcggggcaatgatagccagcagtgaaggtacgaccatttcatgctgtgcccctttggtggaaatctctacgcaacgggcataatcgggttccgcttttccggtcaggatacccggtatttcacggaactgacggcgtacttcttccaccatatgtccggctgcacggccgacggcattcattgtcaatccgcagaacataaaagccatcatcgatccgaggaacatgccagacagcactttcgggttcatcaatgtgacatcataataaaccatgaagtcggagaaagaggcttttgaaatctctatcgtgcgtccgtcggcaaacgaaagaacggtctcgcccagtcgcaggaggccgatttttatctcttcaatataggaagccagtaatgccagtcccgtcagggcagccgaaccgatggcgaaacctttacctgtggcagccgtggtattccccagcgagtcgagggcgtcggtgcgtttgcgtacttcttttcccaggccggacatttcggcatttcccccggcattgtcggctatcggcccgtaagcatccgtagccaatgttatacccagggtggatagcattccgacagcagctataccgataccgtaaagtcccattccggtattattgaaatcaaaaccggaagcaaagaggaaggagcagatgatacctacgacaactgccaataccggaatggcggtagacatcattcccagcccgagccccgagataataacggtggccggtcctgtcaatccggattcggatacccgttgtgtcggtttatacgattgtgaagtgtaatattccgtagcctgcccgatcacgatgccgaccagcaaaccaataataaccgagcagctgatccagaaccagttgtcgagtcccagcagatacaggatgccgaaggtggaaatggcgatcaaagccgaactcaggttggtgccgacggccagcgctttcagcaattgccggatcgtggcattctcgttcgtacgtacggcaaatattccgatgatggaaagaatgatacctacagcggcgatcagcatcggggcgataactgccttgtattgcatttccacattaccggaagaaacgaaagcggcagcacccagggcagccgtggccaggatagaaccgcagtacgactcatagaggtcggcgcccataccggcaacgtcgcctacattatcgcctacattgtcggcaatggttgccgggtttctcggatcgtcttccgggatgccggcttcaaccttacctaccaggtcggcacccacgtcggcagcttttgtatagataccacctcccacacgggcaaagagggcctgggtggaggctcccataccgaaggtcagcatggtggtagtgattatggtcagtttatgtgtaggattcaatgcttcgtcggggataagagcattcaacaggaaataccagaaagagatatcgagcagtccgagtccgactactaccagtcccatcacggccccgctgcggaaggctacctgcaaacccttgtttagggagctacgggcagcgttggcggtacgggcggaagcgtacgtggctgttttcattcccagaaatccggccagccccgaaaagaaaccgccggtcaggaaggcgatgggaacccattcgttctgcacgccgaaaccataggccataatggaaaacaggatgaccaatacaaggaaaaccgaagctactaccttgtattgttgtttcaggtacgacatcgcaccttcacgtacgtacgaggcgatttttgccatcgtttccgttccttcactctctttcatcatttgccggaagaagaaccaggcaaataccagcgccaggatcgacgcaacgggaataatccaaaaaatacttgttatcatagcagttcgatttaaaagtttctttcggaagaaggctttcaaagccttgtttcagtcaccgtaaatgtaacaaaaataaagacgtagagaaacttttttggaaataatactgtttcattctaaaaaaaacagcatatttgttaccgttaaaaagatgagacatacaatgacgcaagattcaaaccatacgacaacctataagttgggcctggccctgagtggaggaggcgcaaagggatttgcacatataggtgtatttaaattattggaagagtgtggattgatgcctgatgtaatcgtgggaacgagtgtcggtgcgttgatgggtgctttgtttgccgacggttattcggcagacgagataaaagaactttttagcggccgtgaattctccgagtttgcacagcttcaacttcccaagtcgggattgtttgacagcaaacgtttccgtcatttcttacgacgccatttgagagcaaaaacgtttgaagaactgaagacccctctgattgtaatggctaccgacctcgataatggtgaaagccatgagttccgtagcgggccgattgtggaagctgttactgcttcgtgcagtatacctattatttttagcccggtggttatcaatggggtgcattatgtagacggcggtctgttccataacttcccggtttccattatccgcgattcgtgcgaaagggtgatcggggtgaacgtgagtccgcttgtttcacagaaatacaaacagacgatcttccatattgccgagcgttcgtatcattatatgttccgcgccaatacgatagaagatcgcgaaatgtgcgacgtattgatcgaggcggaagaattcggcatgtataaaaccttcgatctggagaatgtggatcagatttccaaaatcggttattctgccgctgtccgggcattcgaactggtgatacaagaaaataaatatgaaactctggtaaaagcaattacatcccataagacgaatatccttatgccgtgattggacccggcttgcgtcggagtaacttttaccgataacttaaaagttgataaaagcgatgaaacaaaaggacaaaatgattatatatcaggtctttccccgctggtttggaaattcaacctttccattggtgaaaaacggtagtattgcggaaaacggagtaggtaaattttcagcctttactcctacggcgttggcaaagatcaaggagctgggtattacgcatgtttggtataccggtgtgatcgaacatgctacccaaacggattatactgcttaccagatacgcaaggatcattccgctgttgtaaaagggaaggccggttctccttatgccataaaagattattacgatatcgatcccgacctggccgaccgggtgcccgaccgtatgaaggagtttgaggcattggtgaaacggacgcacgatgcaggaatgaaagtgattatcgactttgttccgaaccatgtggcacgcgaatatcattcggatgcgcgtctttcgtttgtggaagacctgggacagcatgacaatacaacgaaagctttcgacataaacaacaacttctattatattcccggacagcctttgcagctgcatttcggtgccaaccaggaagattttgaatacagcgagtttccggctaaagtaacgggtaacaaccatttcgatgcagcccccggccggaacgactggtatgaaaccgtgaagttgaattatggagtggattatgtgaatggcggcatctgccatttcgacccgataccgaatacctggacgaagatgcttgacatccttctgttctgggctggaaagggtatcgacggtttccgttgcgatatggcggaaatggtcccggtagagttttggaattgggtgattccgaaggtgaaagagaaatataatgtttgttttatcgccgaagtgtataacccgaacgaataccgcaattatatcttcaacggccatttcgattatctgtatgataaggtaggcctgtatgataccatacgtgccgtgatgtgcaaccaggctccggcaactaatatttccggctgttggcaagccctggaaggtatacagccacacatgctgaatttccttgaaaaccatgacgagcagcgggtggcgtcttacttctttgccggtgatccgcgtccgggtattccgggtatgatcctgtcggccaccatgaataccaatccggtgatgatttatagcggtcaggaactgggtgagccgggtatggatgaagaaggtttcagcgggtgcgacggccgtaccacgatattcgattattggagtgtggaaagcctgcgtaactggatcaacgatggcactttcgatggcggcaaactgacgtccgagcagcgtcttcttcgtacgaagtatgcaaaaatactgaacatcgctaaaacagaacaggttattacctcgggggcgttctacgacctgatgtatgccaactcgcgtaatccgtattttaacgcgaatcgccagtatgtgtttatgcgtaaataccagaacgaagtgttgctggttgttgtcaatttcgataagagcgagcagaccgtacgggtgaaaattccatcggaagcatttcattcgcttggatttgacgataataaggcagctgtcctgaccgatttgctgacgggagaaacgagtatcagtacactgacggcggcttgtccgtttcagttgactcttcctgcctattccggtaagctactgaagtttacgtataagaaataatgggtttacatacgaaatactgataagaggggcgggggtgactcgcccttcttgttgaaagttttctgaagataaggagattattgcaaataagttttgtacttttgcaccacaattcaaatctatttacttaagataaatattcggaataatgagtgcacaaactcctttcttggtgttttcgggaaccaactcccggtatcttgcagagaaaatttgcaatagtcttggttgtcctctgggacagatgaacattcaacactttgctgacggtgaattttcagtttcttacgaagagtctatccgcggccgcgatgtgttcctggttcaatcaacatttcctaattcggacaatctgatggaacttctcctgatgattgatgctgctaaacgtgcttccgcacactctgtaattgctgtcgttccttattttggttgggcccgtcaggacagaaaggataaaccccgtgtgtctatcggtgcgaaactgatcgctgatatgttgagtacagccggtatcgaccgtttgattacgatggacttacatgctgaccagattcagggattctttaatgttccggtggatcacttgtatgcttcttccatcttccttgattatattaaaagcgaactgcctctcgataacttgtgtatcgctactccggatgtgggtggtacgaaacgtgccagcagctattccaagtatctgggattaccgatggttatctgtcataagtcacgtttacgtgccaatgaggtggcagaaatgcgtatcattggtgatgtggaaggcttggatgtccttttaatagacgatatggtggatacagccggtacaatcacgaaggctgccaacctgatgttggagaacggtgcgaagtcggttcgtgctattgccagccacgctgttatgtctgatccggcttcaacacgtgttgaccagtcggcgctgactgaaatgatctttacagactctattccttacgctaagaaatgcgaaaaggtgaaggtattgtctgttgctgatatgtttgccgaagcaatccgtcgtgtttgcagtggcgagtctatcagttctttgtatgctatttgattttatacaaaataataaacaggcacggattacacatttactggtggttccgtgcctgtttttttatgcttattccccgatatatcctttcagggcattgacgtagttttcgaatgcctgcctgccgggaggtgctatgcggcaagtggtgcgaggcttctttccgacaaaactcttttcaacttctatatagccggcttcgctcagtttatctatctgcacactcagattgccggccgttgcctgtgtcttttctttcaggtagacaaaatccgcctcctcgaccgaaagaagtatagacatcacggcgagccgtaattgtgagtgaagtagcggatctagttctttaaacattgcttttgggctttattgttgacgatatgtccgggtatgatcatcataaacacgaacgataaaccgaagtaaagataccataaagttgtcgctttttcgccaatcgtcagcatggtgagcatataaattgcgataataaaagcaatcagaggtgtataagtcatccagcgctcctgtatgataatgccggtaatggaaacgccgattccgcaataaatcaaagagagcggcagcatcaggataaagtcgatataccgggcgaaactaaattcgatgataccgatcgtcagaaaagtaacgatgatcccattacctgccatacctttgagatgactttgtcggtgtaagtcactactttcggcggtttttgtctttgtctgtaagacattatcggccatataacgaacatcagcatccatccccaactccatataaagttgtgtgtcagactaatcagtgcaaataaaacgattgataggaccgttgtgaaatagccatatattagcatgatattcccttgcccaatctccatgttctttttactggagtttatcatttgagtgatgagcgccaggctctctttctcgtttagtgttctttcttccatgattttatatgttttttattttgttcttaatatgtttgttcaaagataatgtcattgtttttaacagtcaatcattccggtttatttttcgtttaaccggtttctttccgagtcgggacttcgctctaccgttttctttttaatcttccgaccgctgttgaagttccaggtcagggagactttgaatgtacgtcccaggctatcgctttcgtaatggctccgtgtcgtatatgcatcgatatggctcacgaaattattgtagcggttgaagatgttgttgaccgatgctgttaacaggaagcggttgcctgcgaatttttttcgcgcggacagactgaatatatggcgggaggcgatttcgctgtttccggaatacaggcggcttgttccgttgtactgagcttccaatgtgatgtcttccggcaatcggaaagacgtattcatgttggcaaaggccagataatgatctgcgaaagcggcttcttccgtcatgcggatatcttgctttacgcctacgaaattaaccgtcaggtcgagccacggggtaggttgcaacggtatgttggctgcgacgaaccaatggttttcgatgttatggttctcataggtgatataagatacatccggatcggttgcatcctgtttacagaattcgcggatcaggtcgtggtgcaggttaccgccgatagtcagtgtataacggtagttgtagactacggtggcactgaaacggtggatatacgtcggcctcagataaggattaccgatgttatagctgtaatcggatgtctgaaggcggttcggattcagggtgtagaacgccggacgttcgatattgcgggcatattgtccgacaagcatccatgttttcaggttgttgaaagcatatgtgatattcaggttcgggaaaaggtcgaaataatcccggtcgatgtggtcgcttttattggatgtccgggtatattctccccttacgcctgcgatgaacgaccagcggttgacatcggcagaaaaggaagcgtatgctccgaagatgttctctttatatttgagcgcgtatccatatcccgggtttacgttccattgttggttttccgacaaaccttcgtagcatgcgttatcgtccatgaatgtaaaggtgtacttcaggccggtgttcagtgacattcccttttcgacatatttcctgagcgagatgtccgaagtgacgatctggtaggttgcattcgaattgctcctgtatgtactgtctctatgccattctttctgcatggtgtaatagttgttctttccggtcgactttttattggcgtaatccgtgatcagtttaaggacggaacctttattatcgagtttatgcaggtagtttaccgtggcggataacgtattatagtcgtctttctgataataatctcctgtactgttcaatagaaaaccttgtttcgttaattctgtttcgctgtaagaactacttttggaaacttgtccgatatattctatttctgcaccgatactgttgagtgtgtcgatttcaaaaatggaactgatacgtccggttccgtagttcgaacgggtatcgaattcggaaaaactcgaaaaacggtcgctatcgtttgtgtattctctggaggaagtcattgcactattgtttttaggagtgaaagagcctgatgccgctgcatttaccgtccattttcccatacgggcgttcaatgtcgcggaaggcagaaaacggttcagggaagatgataaagccgtccccatcgttatatttccttgcacgccgttgttctgtcgctgccggagtgtgatcgaaatgatcccgccacgggtactcgcctcatattctgccccggcaatggggatgacttctatccgtttgatctcttccgatttcatggaacgcaagtaggagagaagttcttcgccggtgagtttgatctcccggttgtcgacaaaaacttttgtgccttgcgcaccattgatggatatgttttcgtccgtcagccatacgccgggagcctgcgagagtaactcggttccgtctttcccgctggaaggggaaacggataatatgaagcggtcggctttccgttcaatgtttttagcttgtatcacaacctctttcaaggcataggaggattgtttcagtgaaatggtatcgggatgggagagcggtaaccggacagttttccgcaccggatcgtatccgagacattgggtgacgacagtataagttccgttttttacttccagtttgaagtcaccttcatcattggtcgtagccccggctttctgcatatcatctttcaacagaacaatggtggcatattcaatcctttttcccggtccatccgttatatgtccggagtaaaccgtcgttcctgccggcttttgggctatccccgaaaagctggcagcgaaaaagaacaggatgaataaaatacttttcatgatattattcgcttgaaggataatataatttaagcttgactgtctcttcttcttttggggttttgcaatttttcatgacatatccttcggccggtttatggtcgtctgtgaaatccattttatgattgccgttctcatcgtggaagactgagaggtcgaactgttcccattctacgttttcgagtgtgacggtggcttctcctttttcgggtttagccataccgtatacgggtttgctttcttttcctgactgggccatgacgaggatcatgccgttatctcctcggatattactgatttttactgtaatggtccgcgaccaggccatgctgccggtaaaaaacactgccatgataattagtaatattgttcgtttcatttttcttcctcctcttctttaatcatataatgactcgcgatctctaatcccagattgatgccccaaccggcaattacccacaaaacccaccagtaatatggacttgtgacataatttactactgccaaaaagcagcatataacgatatagcggaggatgttcatcttcagctgcgctggaaatgaattgtttttcttgtttgagtttactgttgcttccattgtcgttttctctttaattgttgtttgtaaaatagtttatatcataaactatgtatggattaaaaaagtgcaaggagctgcgcatttctcacttacacactgcaaatataaaatggtttatattataaaccaaatgaaagtaaggaaaaatgaaccgattaggtataaatttatttttctatcctatctgattagatttatatagcatactaaatggatttactatggcgggaaattagtggttgataattgtcagccattaaaaactaccagggataatgaggaaagtttaggataaacttattttgtaagtgctttaaataaaaaaagagtacataatatgtgaatgtactctttttttatctaaaatagatcggcatgagaaccggtatctgtaaataaaagtattaattccgtatcgttttggtcccagactaacagccagtccgattggatatggcattcccacaggccttcgtatttgccgcttaatttgtgtgggcgaaacgaaggagggagtgtacctgtttcacaaaggatatcaatcacgttacgtaaaaggttcatgttatagcctcttttcttacaacgtttgaagtctttgttgaatttgtgagtcgtatcaggtctgtatctcattttataagatccttccacatttcgtctacattagaataagaatatactcttccggcttttacatcttccaaagcctcgtccaatccacatttcttttctttgcgaaccgtgatgcttcctcccatactttttaccagtttacgtatagcagatacgtatttttcgggaatggagatttcgaatgtttttaaagttgttgtttccatagttgtttatattatagtctgatacaaagataagtataattattgacaaaggtttatttttcttcgtcgattatcataccgctacccaggcagagatgatggtctttgtcgtagacaacgccgtactggccgggggcgatgccctgtattttgttctcggactcgatacgatacaaatctccgatacggcggatacgtcccggggtaaagtccggggtatggcggattttgaaggtgatctccttctcgtcggtgaactctccccacgggtcttcagtgatgaagtcgaaaccgtgcaggttgatcgttttgccgtattgtgtttccgggtcgtagccgttggagacgtagatgatattgcgtttgatatctttcttgataacaaaccagggaccgccgctcaatccgagacctttgcgctgcccgatcgtatggaaccagtaaccgttgtgtttacctaaaactttacctgtttccagttcgacgatcttgccgacacgttttcccaggtaacgttcgataaagtcattatagttgatcttgccgaggaagcagataccctggctgtccttacgcatggcactgggtagcttctgttcggcggcgatggcgcgtacttcggatttcatcaggtggccgatcggaaacatcagcttccggatttgaagacgggtgatctgtccgaggaagtcggtctgatcctttaccgggtctttggcggtagaaagccatactttgccgtctatctcggtcgttgtggcataatggccggttgcgatcttgtcgaagtcttttccccatttctcttcgaagcaaccgaacttgataaatttgttgcacatcatgtccgggttgggagtgaggccgcgtttcaccgagtcgatcgtgtagctgaccactttgtcccaatattcgtcatgcagagataccacttcgaagcggcaaccgtatttgcgtgctatataagatgttatttctatgtcttcttcggcaggacagtcgatatatccgtctttatcttccataccgatgcggatatagaagatggtaggatcgtatcctgcctccttcaactgatggacaactacagagctgtccacacctcctgatactaatgctgctatttccatattcttagaacatattgatgacaaaggtactacaattttgatttgatgcaaagatacgtctccttgcgtcagttgcacaacgaggagggtacctaaagtgtgaaaaacagtgaacaggttttttcgcctcgtaaaacaggttttttcactgaagaaaactatgtttttgtgcatcccttgcttacgccattacaattacaattattacaattaatttttccgtaatgctctttggaaaatgtggtatgttaattttaataatatatattattaacttctataaagagcggcaatagtgcaaaaaaataattgtaataattgtaattgtaatggtaacggttgttgctgttttttgcgcgaaaggagatgtggaaaataggatatcggagatttgtttattacctttgcaaaaggaccatcgcactggtggagtcgacgaataaaaagaaattgtaatagtatgaaaaatatatttgtatcgcttatgacaacaatggcaatgactgcttgtgccggtccgaaagaaaataaaggacaggcaccgcagggaaaatttaattatgtggtagaccagttcgccgacctgcagatccttcgttaccaggttcccggattcgagtctctttcgttaaaacaaaaacagttattatatcatctggcagaagcggcacagatgggacgcgacatattcttcgatcagaactgtcgttacaacttgccgatccgccgtacattggaaactatctataaggaatataagggtaaccgtgaggatgcgcagttcaaggcgttggaaacttatctgaaacgggtatggttctcgagcggtatccatcatcattatgcagaggataagtttactcccggcttcactcctgagtttttcaagagttgcctggagcaggtgaatgcagcagaattacctttacgtgagggacaaacgctcgaacaattcatcgcagaaatctccccggtaatctttgatccgacagttttgcccaaacgtaccgttcagagcggagatcgggattggatacaagcatcagccaacaattattatggcggaggtatcactcagaaagaggtggaagatttttatgcagcgatgaaggtcggtcaggataccatcactccgatctcttacgggctgaatagccgtttggtaaaagaaaacggtaaggtggtagagaaagtttggaaagtaggcggtctttactctgctgcgatcgagcagattgttaaagaacttcagaaggctgtcccttttgccgaaaatgaagcgcagaaagcaattatcgaaaagttgatcgcctattatcaaacgggagatttgaagacattcgatgcttattctatcctttgggtagaagatacagtttcggatgtggacttcgttaacggttttatcgaaacgtatggcgatccgctgggtatgaaagccagttgggagtcgactgtcaattttatcaataaagaagcgactaaacggacaaaggtgatcagcgataacgcccaatggtttgaggatcactctccggtagacagccgctttaaaaaagaaaaggtaaaaggggtaagtgctaaagtaattaccatattgatgctgggtggtgattgttacccggctactccaatcggtatcaacctgccgaatgcagactggatacgtcgtgatcacggttctaaatccgttactattgagaatataaccgaggcttacgataaggcatcgcaaggtaacggtttcaatgaagaatttatctggagtgatacggagcgcgaagctctcaataaatacggtttcctgaccgataatctgcataccgacctgcacgaatgtctgggacacggctccggcaagcttttgcctgacactgaatcgggtgcgctgaaagcctatgattctactctggaggaagcgcgtgccgacttgttcgggctttattacctgggggacccgaagctggtagaactgggattggttccggatggcgaagcctataaagccgagtattacaaatacatcatgaacggtctgatgacccagcttgtccgtatcgaagcaggcaaagatgtagaagaagcccatatgcgtaaccgtcagctgatagccaagtgggcttatgagaacggtaaagccgacaacgtgattgaatacaagaagcgtgacggtaagacgtatgttgtggtcaacgattatgaaaagttacgtaaactgttcggaactcttttggccgaagtacagcgtatcaagagcgaaggagactttgccgccggtaagcagctggtggaagattatgccgtaaaggtagatcagacattacatgacgaggtgcttgcccgttatgctaaactgaacctggccccgtacaaaggtttcgtgaacccggtaatgaaagaagtgaagaacgataaaggcgaagtaaccgatatcgtactcgactatacggaaggctataccgaacagatgctccgttacagtaaagattattcattcctcccatcttacaacgactaagctatgctgcaagaccaattaagagaaatacgtactcaactccgcatggctatgaatggggtgatctccaccagtatgcgcgagaagggcgtagtttataaactgaacttcggtgttcctctgcccgaagtcaagcagattgcggccaggcacgaacccaattccgaactggcagccgctttgtggaaagaggatatccgtgagtttaaattgctggctcctttactgcaaccggtcggagagttttcgttcaaacaggcggagcagtgggtgaaggaaattccttatctggaaattgccgagcaatgcagccgtaccctttttagcaaacttccgtatgtcgaaaacctgacgctcggacttgtcttcaatacgaaagacgaatatgcccggacagtggcttacctgatatggggcgaactgttccgacagggaaaagatataaccccgcctgtaaaggccgcttttttggctgaatctttgcgtacggtgttgtggacagacttcggtgcatcgtggaaagagatacaggccgctgtaaaagcaatgaaattttacggccgtcagtccgaccgccatgccaggcagatattaagtagtttcgaagattttccggagctggcgacctctccggaaaagcaagaaatctataatgatttaaaatttgaatttgaatattatagctaaggctttgcgtttaaaataaatgcgctaactttgtcggtcgcgtggtgtcgcaacagaatggatgaaaagaagtacatagaactgaaacagtcatttacggagtatctgactgagaaaaaactacgaaagaccgaggaaagatatgccatctttgaatgcatatgccgtttctctggtcatttcgacatgtactcacttcaggaaaagctggaagaaacacattttcatgtgagtaaggcaacgctttacaatacaatggatgtgttggaagacggcggaataattgtgaggcatcaactaaatgcccagtcggttcaatatgaactgcgggccctggcagaaacgcatttgcatttgatctgtatgaagtgcgggataatcagggaaatgaaggacagcgtgttgaaaaaggatgtcggcaatttgaagatatcccgtttcacacccgagtttcattcgttatacatttacgggatatgcagtaaatgcaagtttaagcttcaacagagaattggcaaataagaatattaacagcctattataaagacaaaatgaaagtagatgttttattaggattgcaatggggtgacgaaggcaaaggtaaagttgtcgacgtattgactcctaactacgatgtaatcactcgttttcagggaggtcccaatgcaggacacacattggaatttaacggagaaaagtatatccttcgttctattccgtcaggtattttccagggggggaaggtgaatgtaatcggtaatggtgtcgttctcgacccgttattgttcaagcaggaagccgaagcgcttgcagctagtggtcacgacctgaccaaacaactttgtatttccaagaaggcacacctgatccttcctactcaccgtatgctggatgctgcttacgaagctgctaagggttccggcaaaatcggtacgactggtaaaggtatcggtccgacatatacagacaagatcagccgtaacggccttcgtgtcggtgatttgttgcataatttcgatgaaaagtatgctgccgctaaagcacgccacgaagcaatcctgaaatcactgaattattcttacgatatcaaagaactggaagctcaatggtttgaagcattggaatacctgaagaagttcaacctgatcgatagcgaacatgttgtaaacaactacctgaaagaaggtaagtctgttttggcagaaggcgcacaaggtactatgctggatatcgacttcggttcttatccgttcgtaacttcttcgaatacgatctgtgcaggatgctgtaccggcctaggagtatctccgcgtaatatcggtgaagtatacggtattttcaaagcttactgtacacgtgttggtagcggtccgttcccgacagaattgttcgacgaaacaggcgatcagctttgtacactgggacatgagttcggttctgtaacaggacgtaaacgtcgttgcggctggatcgacctggttgctttgaaatatgcagtcatgatcaatggtgtaagccagcttatcatgatgaagagcgatgtactcgacagtttcgatacgatcaaggcttgcgtcgcttacaagatcaacggtgaagaagtaactgaattcccgtttgagatcgacgatacgatcgaacctgtatacgttgaactgccgggttggaagacagacatgacaaagatgcagagcgaagacgaattccctgaagaattcaacgcataccttgctttccttgaagaagagctgggtgttcctgttaagatcgtgtcagtgggacctgaccgtgaacagacaattatccgctataccgaagaataatcataaaatactattacaaaatggcagaagaccacctctaagcaggcctatcttctgccatttttgtttctggcagactttttgtaagacatttcttatataacacttaattaattagagcattatgagcatgtattggattatatttattggttttgccttgttaagctggctggtgtcttcccgactgaagaacaagtttgagaagtattctaaaattcctatgcctaacgggatgaccggaaaggatatagctgaaaagatgttgcacgataacggcatctatgatgtgaaggtgatttctactcccggacatttgacagaccattacaatccagccaatcaaacggtaaacctgagcgagtcggtatattatagtaacagtattgctgctgctgctgtggcagcccatgaatgcggacatgcggtacagcatgcaacggcttatggtccgctgaagatgcgttcggctctggttccgatcgtaagtttctcttccaacattatgacctgggtattactgggtggtatgttgatgttgcatacatttccgcagttgatgttgatcggtatcatcctgtttgcaatgactacgctgttcagtttcataacactgccggtcgagatcaatgccagccagcgtgctttggcgtggttgagtaatgccggaataacgaatgcctatacacatgataaggcggaagatgctttgcgttctgctgcttatacctatgtggttgctgctttgggatcgctggctaccttgttatattatgtaatgattttcctgggcggaagaagccgcgactaaacgaaaatgactgcggctgcggataaaaccggctgctgcaccctctaaaaatagctgcccgagccattcaaaatgactcgggcagctatttttatttcttctttcatagtctcgttatattttgattatgttacaaacatcgcaaaaagaaacagataaaacaatgaacttaacttggaaactacgaaattgaaacaaaatacctacctttgcattccgaataataatttaatagataaaagtcggttagctccgacgataaagaagagcaaacgatatatgcagaagccatctatacctaaaggtacaagagatttttcgcccgaagaaatggcgaaacgtaattatatattcaacactattcgcgatgtatatcatctgtacggatttcagcaaatcgaaacgccggccatggagaacctgtctactttgatgggcaaatatggtgatgaaggtgataagctgcttttcaagatattaaactcaggcgattgcttctccggtattaccgatgaggagctgcaggaacgtaatcctgtacgtttcggtgtgaaagcctgcgagaaaggtctgcgttacgacctgaccgtaccttttgcccgttacgtggtgcagcaccgcaatgatataacattccctttcaaacgctatcagatacagcccgtatggcgtgccgaccgtccgcagaaaggacgttaccgcgaattctaccagtgcgatggtgacgtggtcggttccgactcgctgatcaatgaagtggaactgatccagatcatggatgaggtattccatcgtttcggtatccgcgtttgcatcaagatgaacaaccgtaaaatcttatcaggtatcgccgagatcattggtgaagcagataagattgtcgacataaccgtcgctatcgacaagttggataagatcggcctggataatgtaaacgaggaacttcgctcgaaaggccttaccgaagaagccatttcccgcctgcaaccgatcatcatgctggcaggaaccaaccgcgaaaagctggccgttttgaaagaacaactggctgcctccgagatcgccatgaaaggggtggaagaaatgaccttcatcctcgaccgtatcgatcagctgcctatgaactccgaactggagctcgacctgactctggcacgcggactgaattattacaccggcgctatcttcgaagtaaaagcactcgacgtccagatcggaagtatcaccggaggcgggcggtatgacaacttgaccggcgtatttggcatggacggtgtatcaggtgtcggtatctctttcggagcagaccgtatcttcgacgtactgaaccagctggagctgtatccggccgattcattgaagacaacacagctcttgtttgtcaacttcggcgagaaagaagaaagttatctgctgcctattatcgccaaggtacgtgctgccggtatccgtaccgagctcttcccggaagcagccaaaatgaagaaacagatgggatatgccgatacgaagaagatcccgtttgtagccatcgtcggcgaaacggaaatgaacgaaggaaagatcaacttgaagaatatgatcacaggcgaacaaaagcctgtaacagtggaagagctgatcgcacagttttgatttgcttaaggaaactaacgaatacaacgacttctctttgaacgggagaagtcgttgtcctttatatttgccgcttatgaaaatatacagtttaattctcacaatcgctttatgcctttcttcctgctctttccaacccagagcctcgtgggtgacgactaccgaaaacgaaccgtggcaggaacaggatgacctgatctcggcatccccggataccattccggagatcgatgcgattatccatacccataaaaagcaacagaagatagacggtttcggagcctgcttcaacgagttgggatggatctctttgagtaaactcgatccgatcgtaagggaggaaattatggaagaactctttttccccgagataggagcaaacttcactatctgccgtatgccgatcggtgccaacgatttctcccgcgactggtattcttataatgagatagacggcgacttcgatatggcgtatttcaccatcgccaacgatcagcaaacactgattccttttatcaggaatgcacagaaatacaattcggacctgagtatctgggcttccccttggtgtccgccttcctggatgaaatacaataaacattatgcatcagcctatacgggagagaatttcaatgagaaataccgtaacggactggcggccgataaagtcggctacgaaggtacggatatgtttattcaggactcactctatcttcaggcttatgccttgtatttctcaaaattcatcgaggcctaccgggaacaaggcatcgatatctttgccgtcatgcctcaaaacgaattcaactcggcccagatattccccagctgttgctggacggctacttctttagctaactttatcggtaactatctcggcccggctatgaaggaacaaggtgtaaatgtcatgttcggaacgatggaacgtgccaatgaagccctggtcgacactatcctgacagatccggcaagtgctgaatatgtcaaaggtgtcggttttcaatgggcgggaaaaggagcgatcaaaggtatacacgaacgttaccccgatatgaaactttatcagaccgagcaggaatgcggcgacgggaagaatgattggagcggtgccgtttactcttggaacctgatgcgtcattacctggatagcggtgcttcggcctatatgtattggaatatttccctcgaaaaaggcggtatcagccggtggggatgggcgcagaattcgttggtggtggtggatgccgatacgaagactttccgcttcactcccgaatattatataatgaaacatctgagccattatgtgcaacccggtgcccgtaaactggaaacatcaggtctgtataccaatctgatggcttttatcaatcccgataaaagcatcgttgtagccctggcgaacgaagggaacgagccccgcaccgtctccgttcagatagacggtcgcgtatatcaacccctgcttccggcacgatccgtatcgactctcctgatagattaatcgataagatagtaatatactttacttttgagttaaaatgtagccacttgtgaactacttctccggtagttttgttctagtctcgaaacaaaaaaggtgataaagatagtcatcctgtcagtcaggtcagtctatctaactgtcgtgttatgcaaatttgtcagtcttttccctgccaattattttggcacagatttcgtatagaagtaaacgtgaattagaaatacacatataaacataacattattaacaattaaaaaatatatcaaagatgaacattagaccattagcagacagagtgcttatcaagccggctgcagcagaagaaaagacacttggcggaatcattattcctgattcagcaaaagaaaaacctttaaaaggtgaagttgttgccgtaggtaacggaacaaaggatgaagaaatggttgtgaagagtggcgatactgtactgtacggaaagtatgcaggaacagaaatcgaactggacggtgaaaagtttttgatcatgcgtcagtctgatatcttagctattatctaatttattaacggacaataaaaaataatataatcatggcaaaagaaattaagtacgatatggatgcccgcgaccttttgaagaaaggtgtggacgaactggcaaatgcagtaaaagtaacattaggcccgaaaggccgtaacgtgatcatcgaaaagaaattcggtgcccctcacattacaaaagacggtgtaacggttgctaaagaagttgaattggcttgcccgttcgaaaacatgggtgcacagttggttaaagaagtggcttcaaagacaaacgacaatgcaggtgacggtactactactgctactgtattggcacaatccatcatcggtgttggtttgaagaacgttacagcaggtgctaacccaatggacctgaaacgcggtatcgacaaagccgttgccaaagtggttgaaaagatcgctgaacaggctgaagaagtaggcgaccagttcgaaaagatcgaacacgtagctaagatctctgccaacggtgacgaaacaatcggtaaactgattgctgaagctatgcagagagtgaagaaagaaggcgttatcactgtggaagaagctaaaggtactgaaactacggtagacgtagttgaaggtatgcagttcgaccgtggttacatctctccgtacttcgtaacaaatacagaaaagatggaatgcgagatggaaaatccgtatatcctgatctacgacaagaagatctctgtattgaaagacctgcttcctatcctcgaaccggctgttcagagcggacgtcctctgttgatcatcgctgaagatatcgacagtgaagcattggctacattggtagtgaaccgtctgcgtggttctctgaagatctgtgcagtgaaggctccgggcttcggcgaccgtcgtaaagctatgttggaagatatcgctgtcctgacaggtggtgttgttatctccgaagaaaaaggtttgaagctggaaggtgctacaatggatatgttgggtactgccgaaaagatcactgtagacaaagatactactatcattgttaacggtgcaggcgacaaagctgctatccaggctcgtatcggtcagatcaagactcagatcgaaaacactacttccgattacgataaagaaaaactgcaggaacgtctggctaagatggcaggtggtgtagctgttctttacgtaggtgctccttctgaagtggaaatgaaagaaaagaaagaccgtgtggacgatgctttgcatgcaacccgcgctgctatcgaagaaggtacagttcctggtggtggtgtagcttatatccgtgctatcgaagcattggaaggaatgaagggcgaaaacgaagacgaaacaaccggtatcgaaatcgttaaacgtgctatcgaagaaccgcttcgccagatcgttgccaacgctggtaaagaaggtgccgttatcgttcagaaagtaaaagaaggtaaaggtgacttcggttacaatgcacgtacagacaaatatgaaaacctgtgtgcagtaggtgtaatcgaccctgctaaggttactcgtgtcgctttggaaaatgcagcttctatcgctggtatgttcctgacaacagaatgcgtaatcgctgaaaagaaagaagaaggtcctgctatgcctccgatgaacccgggtatgggtggcggaatgggcggcatgatgtaatctcttcccataagataaattataaacggctgcttccgaaaaaggaagtggccgtttttttattatatttgtcgcggtttacatatataataatgtatagtgataaagattaaagaaggatttaaaggagaacgttttgtctctttgccggacgaattgctggaggcttatagccgggaaccgcttatcggtaacttatatgtccgtaagatcggtttctttccccgggtgaagtaccattatgtacagaaagaccagggatgtagttatgctatgcttatctattgtatagaaggggagggctggtataccattcatgggaagacttatccggtgaagcagaaccagtacatcattatacctccgaatgtaccctattcctttggctcttccgaacatgatccctggacgatatactgggttcatttcatggggagacttggccgggagtttttgccgtctacaccggtgccgggtacaatcctgcccggcgaatattcccgactgcaagaccgggtgcaattattcgaagagatatacagttgcttctcgatgggatatattaaagaatatatggtttattcgtcgatgtgtctgtatatgttccttacctcttttttgtatttggagcaatatcgttatattaatttacctaatcacaaggaatactcttttgcttcccgtgtgatccattacatgaacgaacatctggaacgtaacctgactttggaccaattggcggcttattttaaatattctccatcccatttctccatgcttttccaaaaagaaacaggggtctcgccgataaactattttatccggctgaagatacagaaggcctgccagtatattgtattgacaaacctgaaactgaatgagatatccacaaagcttggttttgaagagccggcttacttttcgcgcacttttacgaagataatgggtatttccccatccgactatcgtaagaaagagtcggagcataataggagtcaggatgaatgatctgatatgtccttaaaaccgcattatttgtacgttttaaaccattaaccggataagaaagcagggttaaagggaaaaaaatataacaaaaaaatagtgcaactaaaaaagatatgtatctttgtcctacgatttaggtgcaaagcatgcacaaataaaacgatcatagaaggatcgtgagctttatattttattacagtatagattttatttgaactttatattttattactaattaaattatttgattatgaacaaaaagttttctactcttcttgtcggcgccctgctgacaacaagtcttggagctttcgcgcaaggtactacacatgtacataccgatgaaaataagatcggtcatggtattactcttcgtccaactgcaacagccagcgctacaattggtgatggcattaatcatttcgatgcagataaattgtatcaattgacagacgcagatgggaaagtattgatccagactcgtaattaccggacaggtgaattgaatttgaagttggttgatgtggccgacgctcctatcaatgcttctttatggtctattaaagtaactaacgataacgtaagtggtgttagctatacaatgacaaacaaagaaacaaacctggagttggtttatgctcatgttaatgcaactctgtttgatgaacctacagttacttctacaactaacctggatgcttctatcttggaaggatgtctgactaactggacctggtattccacaatttctcagaatacaaattttgattacaaacctatctattcttattttgcaaaccgtgactcggtagttgttcttcagaagaactcaagtagcgaaatcattgcagcgaaatattctcatgtagaagctgaaactaacgttcaggctatcactgatgctgtgaaattgaaaccggttctggctggtggtatcatccttactgctgatgatttgaacagaatggttgacttccagtatgatggtacattcactatcagttctgctgtgactccgaacactgaaagtccgttactgactaataagttcactgctgtggaacttaatgatacagacttcccggttgtttcaactgctactgctacagaatcagttagagagaagttaggtcttagcgccacttctggtgctgatgctttagtagcagaagagttcgtatatcttaagaatgctaaaggtgaagttctgtctgtaggtacagaattttattcaagtctgagtaaggagttgccgttggttttgttggaagatgctcctacaagagtggctattcctgagggaacaaacctgactccgggtacttgggaagctcgtagcttgtttagatttacttactatccttcaaatgatagtttattcatcgagcctatgaatgctctgccgaagaatccggctagcagtttgtggcagaatcctgattttgcattcaactctgtttacaatgacttgacgaagcttcatacaaatacagctgctactcctggtgctgctcttcactctgatgaaaatggtcaggtagctgttcgaatcgcttatctaacagaaggtaaggctgttattactgcaaagaatactgaaacagatggcggtatcgcacttccgggctctctgcagactaaatttacattcaaagatagagactttaagtatctgtctcgcgtaaatgtagaccagggcttgtatttcatcacagatgtagcaactggtaagaatgtggttgacaacttcatcggtcgtttgatgctggatgctgctacaactgctcaggattacaatgatatgcctgctactatgtgggttgttaaaactacgggttgcggtgctgttcctacagttgctatctacaaccgtgaatatgcagacgaagtattcgaaggtcagctttataaagatgaaaagggtgtttatttcatcaatagaaactatcgtagtttcagagataaagaacttcagcatgcagatacatatacatttgcagctgtagaagataacgaagctaaaacaagtcctcgtcatggttacaagcacttcaagactgaagatttgctttatactaagtattacatgaactacaacttgtttgcaaatcaggaactgtatctgaacgtatctgaagaaaagagctttgctccgactccaggtcaggcaacaacttatgaattgacagaagctcagaatattctggttgatggtgacaaggctatcgacgtaccgttcggttacggtgctgaaatcggtttgccgcagcttgcaagaacagcttatgttctgaaagtaagcgacaagaacctgatcgacaacgataagatctatgtatatctggtaagcccgcagggtaagactccttattataaggctatgactaaagaagaagctgctgcttctgctgcagatcaacctaagttaggtgtattctatctgaaagctgatcaggtgaagggtgacgaaatctgctatgtattagtagatatcaacagtggtaatgttttgagaatcagcaatggttggatgcaggcacattgcgaagacggtgttggcgaaatgagctacctgcctttggataacgttgcaaccgaaagagctacagcatttgctattatcacagacaaccgtccattgtatatggatctgggtgaagttggtaaacatatcaatatgttccgtgcaagaggtacaggctctgaattcctgttcgaagattctaacaaccagagcaacgctccgcaggttgtaaaagacttcggttacctgggtatgacagctgaaaagattcagccgatcggtaaagaaagcaaaactgctatctatgctgactatgtagtaagctcaactgaccgtatgcctcagtatctgtttgttgtacgtccggattcagtgaaagacggcaaatggtgtaacactcacggttacaacccgaactgcgaacacgaagttgattacaacggttacctggccggtagcttcctgatcaacctgactgactcggtgaaaggtagcactaacatgttgaacaatcctgacgtttacaaatggcagtcttacactcgccttggtttcgtagaaggtgttcaccaggtagatgcaacaggcgaatatctgtatatcttgaagaatggtaagaaattggcagacctgagaactaaggacggcgttcttgatcctcgtgacctgtacaatactgaaatcttcgaaaagaaaccggtagacggtttacataagaactatgcattctctctgcgtttcacagacgacgatcataaggacttcttactggaatctaacctggatggcgtatctcacattgcttcattcaagggcgcatgggtgaaaatccacaatggtgtacctgtattggctgaatacactgtagataacggtaaccacgaagatgacgacaagaagatgcaggaactgatcaaccaggctcagatcttcaacttagaagatactagcgactttgcaacctctaacgaaggtgtttctacatcaggtgttagcgtaattgctggtgaaggttcgatcactatcctgaatgcaacaggtaagacagttactgtaagcaacatccttggccagactgtaacagttcagaatatcacttctgacaatgcaactatcactgctcctgcaggtatcgtagttgtagctgttgacggtgaaagcgctgttaaagctatcgttaaataaataggaaactcctggtaaaccgttaggttgacaggttacatacaacaaagccccgctggttatccggcggggctttttgcgtatcagggagcagaatcggaatattgtacaactcaatcggaataatatgacttgccggaattgctgaagattgcttcttttgtcaagaaaataatctttgcaattatgagaaaaagaatactatcctttagttgtctttgcattttggcaattacatcatgttcaacgcctgaacgacaattggtgtggaatataggtgtggctgacagttcggccgtcgatctggctttggggcctgaccgctataaagaatttcttgccaatgactttggctttgaagaccggtattatctggttggaaaaagtgatgccaaagagtctttcccttatgttttgcccggacctgccgaccaatggggaggaacttggtctactgccggtctgcgaacgcatgacactaatattctctttgagttggataaacttccggtggaaggagaatggaatctgatagtagatctggccgacaactcacctcatattcctcctctattaaaagtgatgatcaataattgtcaggaagagaagatacaactggctccgggtgggagcgatgcctctattaccggtgacatgagccaggctaaccccgtccacttaattattccagtaaaaagagaatctttgcggaaaggaggaaactgtattacactatccgtcttggagggatcatggcttgtattcgaccatgtagggttggaaggtccgggaagtgtccgggcgatcgctccggaaaaagcctttgtccgttccgttgaagcagctaattatgaaatagaagtagaaggaaagaaagtgcaaccgctgcttgtcgatgtcgaacatcttgaagggcagccgcttctttctgtcagacttgatggaaaagagatcctgtctacccgtctggatacagcccgttattgccttgaagctccgatgccttccgttacggagggagtgacaagtgtctttgaggttcgtgcagatggtaaagtgattcaaaaaggcgaggtgcagcgccagcatcaaccgcttcagtctctggcggaatatgtcgatacaaggattggaacagctcattcccgctggatgatagcccctggaccttggatgcctttcgggatggtcaaactgagtcccgataatcagaatgcaggatggcaggccggttatcagccgacctttgaaagcgtaggctgtttcagtcatatccatgagtggacaatgggtggtttagggatgatgccggcaaacggtcctttgaggactgttatcggtgacgagtctgatccggattccggctatcgttcgcggatcaataaattaagtgaagaagcaccgttgggatattataaagtcgatcttaccgattatggtatccgggcggagctaaccgcaaccactcattgcggtttccaacgctatactttcccgtcggataaagacagtgcccgtgttctggttgatttacatataccggcagagtatgattatcaattgaaagatattgagattaagaaagtgagcgatacccgtatcgaagggtttagccatcagttatctaaaaatgtatggagttctgatgcagaccaggaatatacgattcatttcgtaattgaatttgaccaaccgatcttgtctatgggaggttggataaatgaaaagcaacagctgacagatcgtctggcggcccgtgatataaaagatgccggagtctggttgcagtttgatgccgggaagtcgccggttgtacaggcacgttccggcctgtctctggtaagcatagctaatgcggctgacaatttggaaaaggagatcagtactcctttcgggtggaagtttgatgaggtgcgtactaatcagcagaatgtgtggaacgatttgtttgaccgggtacagatcacgacaaataaccggttggagaaagttcgtttttatacaaatatgtacagggcgttgtgtagccgtaatatatggagtgatgtaaacggagaatgggtctccgccgatgaaaaagtacgtcgttttacggatccggatgatgtggctttggggtgtgatgctttctggaatacgttttggaatctgaatcagttctggaatctggtaaccccggagtggagtaaccgctgggtaaagtctcagttaggaatgtatgatgcaaacggatggctggcaaaaggtcctgccggtatggagtatattcccgttatggtggcggaacatgaaataccgctgattgtcagcgcctggcaaatgggtatccgcggttttgacggagagaaagcttttgaggctgtgaagaagatgcagacagcacccagtcagaaggtttgtggtggttatgccggaaaccgtgatctggctccttatctgaaacatcgatatgtgccgaccgatcagggacgtttctctaatacactcgaatatgcatatgatgactggaccgtctctcagtttgcaaaagcattgaataaggaagatgactatacctattttacagaacggggttcatggtggcggaatgccattaatccggaaacgggatatgctcagatgcgtagtagcgatggtcgttgggccaaagatttcgatccgttccattcgggagccaatcatcattatgtagaagggaatgcgtggcagctgacttattttgttcctcaggatgtccccgcactagcggaagtcatagggaaagatcgttttgtggaacgtctgcaatggggatttgaggccagtgagccctggcggtataatgcgccgaacgaccagtattgggattatcctgtggttcagggtaatcagcaatccatgcattttgcattcctgttcaattgggtcggtaaaccgtggcttacccagcgttggagtcgttctatcgtagaacgttattatggaacgggtatggctaatgcctatttgggggatgaagatcagggacagatgagtgcctggctggtcatggcttctttggggcttttccaaacagacggaggttgtagtatagagcctgtgtacgaaatagcaagccctttgtacgaaaaggttgtgattgatttgggagaacgtttcggcagaggtaagacctttacgatcgaggctcgtaatgcatcccgagccaataaatatgtacaaagtgccgtattgaatggcaagcctttacagtctttccgtttcccggcatctgaactattaaaaggaggctctctgattcttgaaatgtcctcagaacctaattattcgtggggagtgaaagctgatgaataagacactctttgttttgtctggattataatctgtatttcacaggatatttatgtttaaattttctatcacaaggatgtgttatattctttgtgatagaatatatatgttgttttattgttgattacaagtgtgttatgtcgtgtttgggaatagtaagatagtgtaagtatatcggataattttattataattctgtaaaatataacccattactttgttgtagagttaagtaagaattacaaagtagaattaatgggataattatggtatagtatcataaatactaattactaactaataataatagtatgaaacaagttaatcaaatgtctaaacttttcgttcgggacttgagtcgaaggatgaaaattccaatgatcctgattttgtcgtttttagtctttccaggctatctggagtctaaagaagtgttaacacccccccccccagttaaaaacagataataatataacggggaaagtaaaagatgttaacggagagcctctgttaggggtcaatgttatggtaaaaggaacctctgttggtacggtgacggatatggatggttcttattctcttacaaatgttacctctaaagatgtactaattttttcattcttgggaatgttatctcaggaagtgacagtcggaaatcgttctcagatagatgttgtaatgacagaggacgttatcgggcttgaagatgtggtcgtaacgggctatacttcgatgaagcgtaaagatataacaggttctgtcgcttcaataagcgctgaaaagatcagcagaatccctgccaacgatattactaccagcctggttggagttccgggtataagaatggatggtagttctatacgtattcgtggaacacgctctagaaatgccagcaacgatcctcttatcgtattagatggaattccttataatgaaacattatcttccatcaatccgggtgatattgaatcgatagatgtcttgaaagacgcgtcgtccaccgccatatatggggccaaaggagcgaacggagttatattggtcactaccaaacaggcaaaaaagggaaaaacgttggtttcttatgatggttttgccggtatcggagtcaataaccggggctcttttgacgtaatggatgccgatgaatacaccgcttttaaacgtgaagcttaccgggcggcaggaacatggaacagtgaggcggatgatgccaaagcctttgccggagcagagatctcaaatctgggtactatgaatactgattgggccggtgaatattttagacgtaagcgtttttggacaaatcatgtagttacgattgcttccgggaatgataaaacccagtataaagtctcttttaactaccggaatgatgatagccgttatgaaaacaatcactatgataatttttatttgactaccgatctttcgcaccaggtacttccttttctgaaagtcggagtttcaaaccgtgcttattatacaataaaaaatgataaaccggatgtttttcagacagtgatacacatgtctcctctgactccggtaaggaatggggacggctcttataatacgtatccgtttggtgatccttttgtgaaaaacccttatctgaatgagagtgatgaggtttataaagacaagacggaagaatggaagatatttcttcgcctatttgcagaagttaacctggctaagaacctgacttataatacaaactttgcttatagcccttctttttcttccagagggtattactatgacaacagaagtgtatcttatcaggacgatcgtaatgtagcaggtatgcataataaccgtcaggcggactgggtgtggaataatgtattgaattataagctgagttttaagaaacatacctttaacctgtcgggggtatttgaaatgcagaaccgtcagttggtaaataccggtatgtcgggaaaagaacaggaatcaccggcttatctgtggtataatatgggaagactggtagattctaaaactctttcttccagttttacccgttcacaaatggtttcttacatcggacgtgtacaatacgattataatgaccggtatatctttacagcttctttcagagaggatggggcttcccagctttctcagggacataaatgggcaacattcccctcaggagcgattgcctggcgtgcttcagaagaagaattcataaaatcgttaggttggattaccaacctgaagctaagagcaagttatggtttaacaggtaattatgctattgccgcatatgcaactaccggtaatttgtatggtacctatgcgaactttaaaacagagtctggagaaattcattatccgggtttggagccggatacccgaccgacaccgaatctggaatgggaaaagaataaaatgcttgatatcggattggacttcggattccttgacggtcttatttacggttctgtcgactggtacgattccaaaagttacgatctgctttatttgaaaacacttccgtatactaccgggtttaatcgcgcctgggataatgtgggagatacgcgtaacagaggtatagaagcttctttatccggaacaataataaagaaaaaagacttggatctgggtgtgactctttcttactataggaataaagaagagttggtgcgtttgcaggacccaaaaatgaaagaggatattaataacggacttttcgttggctatcctgttagtggtgtgatctatgattataaacaagtcggtatctggcaaacagacgaggcagacctggcctctctctacggacagaagcctggcgaagtgaaagtggctgacttggatggtaatggaaagatagatggcaacgatcgtacgatcattggaaccaacagacctgactgggtaggtggcttgcagatcagcggacgctggaaagatctggatttctccgttgattgttatggtgagttcggtgctatgggtagtgatgattacagtacgaatttctgggcttctgaaatgggacgctggaatactgtaaagattgactactggacaccggagaacccatcaaaccgtcatcctcgtcctgtggccggtcagagtatcaagtatttgagctctacaggatatcataagaataattacgtgaatctcaggaatgtaactgtaggttatacgttgcctcagacactgacgaataaagtcgttaaaaaagttcgtctttatgtaaccgcaaacgatcctgtccggtttagtaagtttcagaattcgggcggtatttcatggtgggaaacattttacattttcggtgtgaatcttcagttctaattataatcggaaaaatatgaaaaagataattataacgggcatgatcgctcttggtatatctgtatcgggctgctcggattttttgaaagaggaatcatatggttcgacgactgccatttttggagaagaaaatggtattaaagcgctcgtataccagtcgtatacaaaagtaaataatctttatggaggtgggggacaatggcctgcttttacagaacatggagccgatttattcctgagaggtggtaattttacagacatgggagtatgcgattattatggattggatgcctctaacggaaatgtcagttggctgtggaaccactgctacaaggctttggcgaatatcaatacattttttgaaaccatcgatgatacgccttttgccaaagaagaagaaaaagatcaatataaggcggagatgaaagtgatgcgttctctctttctttggatcattaccgaaatgtggggagagacctatttgcctcgtacaaccgatgaggttgaaggtatggaagctcgccgctctactcgtgctgacttttacaaagagattatcggaggattggaagaagctataactatgttgccggataagagaacttcggagtttggtcgtatagatatgccttcggcaaaagcttttctagccagaatgtacttatataatgaacagtttgacgaagcgatggatatggcttctcaggttattgacggttcttatggcttggaactttccacatcactgaaagatttgtggaacgacagtaagcggaataaagaatttatctggactacggaatttgttgaagatgaatctttcaggcagagtagttactattggcaacattttgcaatgtttatagaccgctttgccggtgtaaaaacagaatgtggatggaccggctatggtggttgcggtgcagtaccttccttatattatatatcattgtttgatcacgatgctgatttgcgttggtctgatttgcatcagtgggtatggtattataatgatccgtctgatgatacatcgggtttcccgaatatgcaggagttgtatgcggatacggctttatatctgagcatcgatcctatctctactgaagaaaaagccaggatggcttcttgttataccgcgtttgacgtaaatgatttgtatgattcaaaaggtgtgccgactgatcgaaagacatttataggaatgacaaaatttgatgacaatacccgcccgggtgatatgtctaccaattccgatcggaactatccggtattacgtcttgctgaaatgtatctgatccgggcagaagcaaaaatcagaagtaccaataagcaggacctgaagggagccgttcaggatataatgactattcggcagcgtgctataaaaagcggatatgagaaagagatgacagttacggaaaaagatatgactcctgaatttattttggatgaacgcggacgtgaattagcaggagaatttcagcgcagacttgatcttaaacgtctgggcaaactggtcgagcatgttaagctttataatccggatgctgcggctaacataaaagaataccataaagtatgtccgataccgcaaacgcaatttgatggtatgccggattggactacccttggtcagaatgaaggttattaaaatgaaattatatgagaacaaactttataacaataataatgttggcaagccttatgtggatttgccagtcatgcacagacgatgacaactcttccgccaggaataatttagtagaatgcatccagaaagcggaaacttcgattgccgaatctgtggaagcaaatgaagagggttgtatcgctcctggttcgaaagctattttgcagacacggatagactgggcgtattttattcttcagaactctccgtcggatgaggcatatacgaatgcgttatccatattgaatgatgcaattgatgctttttatgctaatgtcgttaaatccggaactccactatttggcataggatccaaaatgaaactgggaactgtgggtgagtggggatttgaagaatgttttaccatagaatgccgggtgaaatatactgagtttgcaggaggcgatcagaatgtgatttcctgcgaaaacggaaattccggatggatgcttagaagtagtggaaatgtcgtacagttctatatcaatgacggagggtgggcaggttgccagacaccggcattggaattgaatcgttggtatcatattgccgcaagctatgaaaaaggtaaagggcttgtattatatctggacggacagaaagtcggaagttcttcttgtggagcattggtcgttaattcagtaaccgatttacaggccggcacggcaccttcttattccaatcgttatatgagaggatatatccaggatctgagtctgtggaaagatgtaagaattgcggaagaagtggtaacagatgtgaactgtaatttctccggaacggaagaagggctgaatgcctactggccattgtctcttaatctgggtacggagattactgatgaaacgggcacacgtgtagccagtctcgtcgatgttgtctgggagagtaatgaataaaagaaaatgaaaatagtatcctttcaatgtcttaaccggcgttggaaggatatttttcagggaggtctttcacttgaaagaatacctgattaaatattctcgaaaaataattacaggatattttgttttataaaaaaaaacgctacctttgcaccgcaatcacgagagattgcttacctgaaaataatgaaatgcccaggtggcggaattggtagacgcgcacgtttcaggtgcgtgtgtcgcgaggcgtgcaggttcgagtcctgttctgggcacttctaaagcggacaactgtaaagttgcccgctttttttatatccgtatttttttatatatttacgccaaaatggagaggatgcagcagtatacagaagatgaactagtggaacagctacgagattcggccaggcaaagggatgcttttgcccgggtggtaaatctttatggggaaaagttgtactggcaaatacggaagatggttttaagccatgatgacgcaaacgatcttttgcagaacacattcctgaaagcctggacaaatatcgattacttccggggggaagcaaaattatctacctggctgtataagattgctatcaatgaatgtataacctttttgaaccggcagcggaatatgaataacgtgtcgatcgacgacactgatgttttcctgctggaacgtctgaaaggggatgagtattttgacggtgatgaagcacagttgaaattacagaatgctatcctgactttgcccgagaagcaacgtttagtgtttaccatgaaatattttgacgagatgaagtatgaggatatgtcggagatcttggggacttccgtgggagccttaaaagcctcttatcatcatgccgtaaaaaaagtagaggagtttttaacaaaagacatttaaaccttttggacgaacgctcgtcaaaagaatattaaaacgcaggagtatggaaaaagaacaaaataatctggatcgttttaaaggaaagaatccttttaccgtgcctgaggggtatatggaggatttgacggctgatataatgagccggttacctgagaaaccgcaagtagaggtgaagaagatctctatgatggatcgtatgcgtccgtggttgtatatggcagctgtatttgccggactgggactgttctttaaagctattgtcggtatcgatggtgatcagagtaagacggatacattattagttcagtctaatgatgcttctgctgcgatatctgctatacaggatgctgagaatgaggaatatctggagtttctggaggcacagtacacggattatcttttagcagaagaattgggcaattatgaataatttgatgaaaaaaagaagttattagcatatttttgtaataatacttgtatgaataaaatattttttattacatttgtggcgatttcagttttattctcttcgaaagtgttggcgcagggagataaacaacatcggcattttgacagagaggcctttcaggcaaagagaaatgcattcattacagcagaagtggggttaaccccggaagaggcagctgcttttattccattgtgtgatgagttgcaacagaagatgtttgaggttggtcgcgaatgccggaagctttcaaaagaaataaagcataagaagtctccaacagaatccgattattcaaaaataaatgatgaatgtctcggagtaaaaatgaaggaggctgctttagaaaaagaatattacgagaaattcaaaaagatattatcgcccgaaaagctctataagtacaggcgtgccgaatataagtttgcacgtagttttatgagagggccggatgataagaaagatgaaaacaagaaaaaataaaatattatcattatttgtgttttttgtttagatttagttttggcgtttaagttaagggaggggtggcgacgtgatgtcggttccccttttgttttttataaccctttcgatttggcttcgtcccagatcttatccatttcttccaacgacatatcttttagtgagcgtccttctttgatggtatgatcttccaggtaattaaaacggcggatgaacttttggttcgtgcgttccaatgcattgtccggattgattttatacaggcgggcagcattgataaggctgaagaacagatctccgaattctccttccattttatctgcatccatcttgtcgatttcctcttttagctcggtgaactcttcatgtactttatcccatacctggtcgcgctgttcccagtcgaaacctacgttacgtgctttatcctggatacggtgtgctttaacgacagatgggagagaagcgggtacaccttctaaaaccgttttattacctcctttttcttttagttttagttgttcccaactctgttctacctttttagccgtatcggcagttgcatcgccgaatacatgcggatgacggtaaatcagtttctggcagaggctgtcgcatacatctttaatatcgaaggcctctttttcttcaccgattttagcgtaaaatacgacatgcagaagcaaatcccctaattctttcttgatgttgttgttgtcattttgcatgattgcttcacacaattcgtaagtctcttcgatggtgttcgtacgaaggctttcgtttgtttgctttttatcccaggggcattttacccggagctcgtccaggatgtctagcagttgcccgaaggcttccattttttcttgtcttgttgccattataataatgtactggttttataatatgacaatatgccaatgaaactcctcctatttatccggagggtatttcaattggcatattggcgtgttgaatttattattcaattacttttcttctttcttgaattgtgtcagtccgttttgcaggaactggatgtattttgatacatcttcgttgaatgcatacgacgggccgagcggcttgccttcgtcattcaaaagaatatagaatggctgggcatttgctccgaacttgcttctctggaggtaactccatttgtctccgatcgttttcaacttacgcactttaccatgttcttctatttcaatcggatgaggcagtttagtcttatcatctaccatcaatgtgatcagtacataatctttctccaatagttgctttactttcgggtctgtccatacggatgcttccatcttacggcagtttacgcaaccgaaaccggagaagtcgatcatgacaggtttgttcactcgtttggcataggccataccggcttcatagtcatcgaaagcggcatgtacttcgtcatcatataagctgaaatcctgtgtatacaaaggaggagcgaaggcgctgatcgatttcagaggtgcaccccaaagtcccggaaccatatacatggcgaatgcaaacgagataattgccataaacaggcgggggacagatacatatttgacatcgctgtcgtggctgaatttgatcttgccaagcaggtaaaggccgagcaatacgaaaatcacaatccacaatacgataaatacttcacggtcaagtaagcgccatccgtatgccaggtcggcaacagaaaggaacttcaatgccaatgccagttcgaggaagcctaaaactacctttacggagttcagccatccacctgatttcggcatactttgcagcatattcgggaagattgcgaacaagctgaacggaatcgataaagccagtgcaaacccgaacattccgatagccgggccaactgctgtacccatcgaagctgcctgtaccaataatgtgccgataatcggaccggtacatgagaaggataccaataccaacgtaaacgacataaagaatatacttaatattccggtagtagaatccgctttactatccagcttggttgtccatgaagccggcaataccatttcaaatgctccgaagaatgagatggcaaatactaccagcagcaggaagaatatgatattgaagattgcgttggtagataagtcattcaaggcactggctccgaaaataccggtaatcagtaatcccataaccaggtatatcacgataatggaaagcccataagttaacgcgtcgcgtattgcttttttacgatccttggttcgtttcaggaagaagctgactgtcatcgggatcattggccatacacaaggagtaagcagggcgatcaatcctccgaggaaaccggcgaagaaaatgaatagccaggaggtatcggttgctgtaactgtagtgtcgccaaaagctttcaagtcatcgacaacgggagtccagagggctgcgtcgtcagtcagtgcgttagctattttagccggactggtgattactttttcagtttctgctgccgggtcaggagttgtaagtgttgctgcttcttcaagaaccaggttggtatccggttgttcggcggttacatcgtctttgtctacgacaggtgcatcggccggtaatgtcagttttgtgttttttgcatcgaaagcgaagcttacccggtcgggaggcaggcatgtctcgtcgttacaggccataaattcaacttcaccttctattttgaatttcttcggatcggttatctttaccttttgagtgaacgatacggttcccggataccagcgaaggtccatggcgaacaattcgtcgtatactaccgtcggtttgacggaggagaccggttgcccgatcaattcagctcctttcagagtctcaaatgtaaaagaggttgatacaggtccgccttcaggcaggttcatgtcgtacaggtgccatcctttctcggaggttgcggtaaacacaacttctttttcggcagttttggagtcttccagttttattttccactttacaggttggtgtatctgtgcctgcacggccagtgttacgaacaccagcaaaaaaacactaaagagtttcttcatacgatatttatttctgtcttagttattatttagctaatgatgtgaatgtagtagggatacgtgtttcaaaacgcatctcttcacccgttgtcggatggataaagaagagtcgtcgggcatgaagcatcagccgtccggcaggatcagtttcggcgccgtacttattatcgccggcaattgggtgtccgatagactccatctggacacgtatctggtttttgcggcctgtctccaggtctagttccagtaaagaataatgaccgttgctgtgtagcaggtgatagcgggtaatagcttcttttccaccgcctatagctgttacgtatacttgcatttttgcattttcagtcaggtttgagacaatcaggtcggtatctttctccggacgtccttctacgacagcgacataactacgagcggtgatagccgagttccagtttgattgaagcgctttttgtacgcgttgattcttggcaaacatcatcagcccggaagtatcgcggtccaaccggtgcaaaacaaatattttgtttttcgggtctgtcttttttacatagtcgctcaacaggtgataggcggtccgctcttttacccggtcgctcgagacggacataagtccttctttcttgttgacaacgatgaggtcgtcatcttcccacacgatgtgtaatagaggattgctgaactccacctttcctcgttcgtaactgatctcgacttcgtctcccggcactaaaggagcgttgaactgggaagtgactttcccgtttatcaagatttgtccgtgggcaagtaaggccttgacggaacttttgctctgttcgttgagtaactgcaaaaggaagggaagaagtgtattctcttcctttaccgcaactttgcgtccgcgaggggcctttttgagatttgtgtctttgtaacctgagcgtcttctcattttattattataaataatttacaaagatactggcatttgcggaatgttgcaagccatgtttcgtaatcttagttattaatcagcgaagctttcgttattttttcttttaagtgaatggtttttgtttgaattcgtatgtcgaaattgagtccttgattttaagttcagagtggtagaaaaatataagaacggatttgttgattatgcttcgtagatgataaatgttgttcgattgtttaaaagttagaataaaatgctacttttgctaaaatagaattggcacaatagagatggtttatacccaaagtagttttgaaaaaatatataagctgtactatccgaagatgtttgcgttcgctaagaactatatacaggcaaatgaagatgcggagaatgtagtgcaggatgtctttgtggtgctttgggagaaaaaggatgaactggaattatcctgtacacttactacctatctgtttaccctcgttaagaacagatgtctgaattatctgcggcataaactaatcgaagaggaatttaatactcaaatgaaagaagaactaggttttaagctatatgctttggaatcattggagtattcgtatccgtctgaaaaagaattgcaagccgttattcaacgggctctcgatgctttgcctgaacgttgccgggaggtatttatcaaaagtcgtatcgaaggattaaaatacaaggaaatttcagaagaacttggcatatcggttaatacggttgagaaccatattgttactgcgttgaaaaagttgcgtgtagcgttgaaagactatttgcctttgcttttatttctggttaattaatgtttatttgttggagaggtatagtggtctgtttcgggataagggtttaactttataaatagaagaaagatatgtatgatctgttatcaaaatatttagcaggagatatttcaccggaagaaaagcagactcttttccgcgaattgaaagaagatgctggtttgaagaaggaagcagccgatatgcaaaatttatcggctcttgtttctatggccggagagaggcgctctgcttctgatatgcaataccggtcgtttgttcatttgcagaaaaaacataccttattgttcaatctgagaaaaatagccggttatgcagcgattatgctcttttcagtgttgtcaacttttctattgatgacttatgccggagggggcggaggcgagcttgtccgttatcaggagttctcgacaccacccgggcaacgggccagggtagtactcgtggacggtactgaggtttggctgaatgccaattcgacattacgttatccggaacgttttgatttgaagcaacgggaggtagaattgcatggtgaagctttttttgaagtagaaaaaaacaaggagaaaccttttgttgtcaagacaagtaaaatggatataaaggtgaccggtacaaaatttaatgtaagcgcttatgaagcggaaaagtattttgtaacttctttggtcgaaggggcggtttctgtttcttgctcaaacgaccggagccgtacttttgcactacgtccgcaacagcaaattatagtatcggattctttatcagaagtcactttgtttgagaataccgattttctgtcgtggagagatggcgtatttgtatttgatgatatgtcgttaaccgatatcattaaaaaactggagttgttctatgatatatcgattgtagtgaaaaacacgaaactgagtaattaccgttataccggaaaattcagacaaagggatggagtggaaagcgttttgcggaaattgcaaattgtatatccgttcacttatacaaaggacgatgagcttaatttgattgttttacagtagataaacccaggttcgaatatacccttgtagagtcgtagcattgtctatgacagccattcgtatggcttctataatcctatatgtaaagcgggaagatggcggaaacaaggttgccgaatattggtatgggaaaccttacaatatcacagatgtgttaaattatatttaatttcattttctgtgtggtggtctttccggcatgaagggtttaacttatagaaaacaggataataatatgtataaccttaaaaataaaatgcctatgatctgaaaaatgagaaaaacctttttatgtaaaaagcagacaggtgctcgaacacctgtctgccatacatctaacactcttagtcgaaaaaagtattaaacatttaattttacaaaggtatggaaaaatatgctttgtcaatctttttatttcaaagaaaacactttaagaagttttttaatgttatgagaatttcaatcctatttctgtttgtcagcattttagcatcttatgcttcaaatgtaaattcacagactgcaaaagtgaatattacgagtgcccgcatgacgatcggaacttttatcaggcaagttgaaaaggaaaccggttatatgttcgtttataataaagaggagattgatgcaaataagacaatttctttaaagaaagggaaaaacacggttgtcgattgcctgaataccatttttgatggttccggcgtttcatttgtttttgatgacggctatgtagtcctgacgaaacatgcacaggagactgccatatcgcagcaggccggtaaagtggtaaaaggcattgttaccgatgagacaggtttgtcggtaattggtgctaatatctttgttaaaggaactaatttgggaacgattactgatatggagggtaattttagtctggaagtaccctcggataatgatattttggtggtttcctatatcggttatgtcgaacagcagattccggtgaaaaacagaaaaaactgggcaatcatattaaaggaggatgcgcagaacctggatgaggttgtggttgtaggttatggaacacagcgcaaaggcaatattgctacagccgtgacgacaattaaggcggaagctctgcaaaatcgtccggtccagacgataggtgaagccttgcaagggcaaattccgggtttgagcgttacgtcaaaaggtgcgccgggcgagtcgccttcacttcaattgcgtggttcttccatgctgaaatccagtacggcagaaacggacaaagaaacgttacccaggctgagatccgaaaccagcgggccgttggtattggtggatggtgtgcccgcggacttcaacttcctgaatccggaagatattgaaagtatcaatgtcctgaaagatgcggcttctgcagcgatctatggttcgcgtgccgcaaacggagtccttctgatcacgactaaacgtggaaagatgggcaagcctactttccgttataatggatctgtcggagtcaatacgccgatgtatatgcctaaatcgatcagttcagccgaatatgcaagaataaagaatgaagcggaaaggaatatgggacgtgctccggtttattcggatgaagatattgccatgtttgccaatggaacggatctgaaccgttatccgaatacaaactggctggacctggcgatacagaacagcgtcaccacacgtcatggcctggaggcttccgggggaacggaaaaggtaagatatctggtaagtgccggtgtcgaccaccagaccggtgttttcccgaatacacagcagaatgtgttcaacgtacgttccagcacggatattaccattactaaaaagttcggtatctcttttgatatgcgttaccagttgagggatatggaggctttgaatagtcaggaagacctgtataaacaattgattgttgccgatccgactatggtggcttattatacggatggttcctatggctataatccgggatttttcaccaatccgctggtgcctttgtatgaagggggccggaagctgactaacagacatgaagcatcgggtattttcaagcttgattatgaatttatcgaaggattgaaatttaccggtattgccaatgtgagatatacattccagaatgaagaatccagagctcgtaagacgttctataaaaactatttcacaggggaagagtttgaaaacggacagaatactttcaccgaccgccgcgattacaacgcttactacaatttacaggctttgctgaactataagaaaagttttggtgttcataccctggatattctgggcggttaccagcaggaaagtgaaaatacagactggctgaaaggggcccgttccggctatccgaccgatattctctgggagttgaacccgggaccgaaggataactggagtaatgacggtaacggtgaacattgggcgctggcctcttttatcggccgtatcaattatgattacgacaataaatatattttatcggtgagcatgcgttcggatgcttcttcccgttttgcgaaaggaagccgttggtcgactttcccatctgtagccggtgcatggagactttcccaagagtcgtttatggaatgtacgcgtagtttcctggatgacctgaaggtcagagtttcctggggacagaccggtagtgcgacgggattaggcctttatccgagttatacattgatatctacaggcggtttgatcctgaataacgtttatcagcagactgcttctttgaaaacgatcggaaatacggatttaacctgggaacatacggatatgttgaacttcggtctggatgtgaaaatgctgaacagtcgtttgaactttacgggagactattatattaaaaatacgaaagatattttattggaaatgcccgtgccgctggaatatggttttggcaaaccgaatatgaatatcggcgaggtgcgtaacaaaggttgggagttgactttaagctggaatgaccgtataaatgattttggttacagtatctcgggtaacttgtcggataaccggaatgaagtgatcgacctgggagatacaggtccgtggaaaggttccaacacctatacggaagtagggttgccttataactctatttacggatatgaatcgatgggattattccagtctgatgaagaggtagccaatgctcctttccagaattcaaatacggctgccggtgatatacgttataaaaaccagaatggcgatgataagatcgatgctaacgaccgtgttgtgataggtgatccgaaccctcacttcctgtatggcgtgaatctgggctttgattacaagaacttcgatttgaatatgttcttccaggggatcgggcagaaagaccgggttataatggataattttgtcagaccgttttatgattcttctatttttgaacatcatttggattactggactccggaaaatacaggtgccagatatccgcgtatcctgaataaggacgacggaacacataattatcagcagtctgattactggatgatcaatgccggatatttccgcatgaagaatttgcagatcggatatactattccgcgtgaaatattaagatcggcaggttttgacagagtacgggtctatttctctgctaataacttgtttactgtatccgattttgtgccgggtatggatccggaatctgataagtccgtatcttatccgtttgcccggacatattcatttggtttaaatgttcaattttaaaaagctgaaaaaatgaaatcaataaaaatatatatatgtgcagccttgatggcgctaggcgtttcttcgtgcgatagttttctgaccacacctcctttggatcagatttccgaagatcaatggtggaacgataaagcccagacagaaatgatggtgaaaggagcttacgagtatgtacctggcccgaatgaagtggtgcttcgcgattgtatcagtgataatgcgacacaccgtgatgccaaatacaaggaagtgggaaatggtacttatacgacacagagtgatgccgttaaggatgaatggcgctatgcatccattgccaaactgaattacatactggaagggatcgagaaggcaaaaggccagatatcggaagaagaatatctccgttttaacgcggaagtacgttttattcgtgcctttgtttactacaatatggttttctttttcggagatgtgcctctgatcactaagacgttgagtgtggcggaagcccgagaaacgtctcgccagcctcgccaggaggtattggattttgtattgaatgaactggaagaaggtgtgctgccgaatatcgataaagtttctgtgacagaaagaggtcgtgttaacaaacaggtagtgaatgcattcctttcacgtatttatctgtacgaaaaaaattatgaaaaagtactttattatacgaacgaggttatcgggtccggagaatatgagcttcatcccaattatgaagaattattccgcccacaggctgacgcaagtaataaagaggtgatttttgaacgtcaatacagttctccgctggttgtgcatgagctgaatcgtaacttgtctccggcttcttccgtttatgccggttggtcgcacgtgttggggttgcaggaattggtagacgattatgaatgtgtgaacggtcatccggtttccgaatgcgaatctctgggctgtgaatatttccagaaaaggaaagatgcggaagctgatacgcatcgcggagaatatgatttccgtgatccccgtctggctgctaccatcatgtggccgtactgggaatggaaagtaggggaaaaagttgtttcccgttatggtgtggatgatccggatagcaaggattatgtaaagaaagaaacacatatgaccggttttcttgttaccaaatgggtggatttgcagggggaatatgcagaccgtacccgcggtcaaaagaatatgacagtcttgcgttatggggatgtccttttgatgcgggcagaagccttgattgaactggggcaggatttgggtggagctgtcgctctgattaatcagatccgtcaacgggcggggatgcctgatatcgcagtcgcttctcaatccgttttgcgtgaaaagctacgccatgaaagacgtatagagactgcctttgaaggtttgcgttatttcgatatcattcgttggcatattgctgataaggtgaaatcgggtaaagtgtatggtgcccgtttgaaggcgatcagtgatgcgatggacaataaatttgtggaagaacgtttctggaatgataaaatgtatttgttcccggttcctcaggaagcaatagataacaatccgaatttggtacagaataaagattggtaataatggttaataattagattgaaaaccccggatctgcatttacggaagaagattcggggtttcctttctgaatataaaagtgattgattttaataacagactattttatgaaaaagaatattttagtgttactattttgggtattgacatttaatctgtccgcctcaggttcgccggaattctcgactgccggtttttatgaattacccaataccggccgtgaggtctattccatgaatctggcatggaggtttataaaaggagatgtgtcgggaactccctatgctgccgactttgatgattccggttgggaagttgtttcgctcccgcacggattggagtatctgccggtggaagccagtggttgtgcaaactatcagggtgtagcttggtatcgtaaacgtttcacaccggatgatcgtttgaagggaaaacaattgttcgtacattttgaggcgatcatggggaaaagtgaggtctatgtaaacggacagttgttaaaaacgcattatggtggatatctgcctgttatcctggatgtaacgaatctcctgaaatgggatgaagagaatgtgatagctgtaaaagcagataatagtgatgatccttcttatcctgtcggcaaaccgcaaaatcttttggactttacctatttcggtggcatttaccgtgattgctggctggttgcacataatgacgtgtttataaccaattcgaattatgaagatgaagttgcaggaggaggcttgtttgtctcctatgccgatgtatctgaaaaaagtgcccttgtaaacctgaaagcccatatccgcaatcattcggcaagtgataaaaaggttacggttacttttgagttgaaaaagaaatcgggtgaaattgtcaggcgcgtttcaacggggttggcagtgaagaggggagatgcctcgtatgctgttggttcgatgaaaattaatacaccttctttatggagtcccgatcatccttatttatatgatctggaagtgatggtcagaggtgccaatggccaggtgctggacggctatcgtcagcgagtgggtataagaagtattgaatttaagcagacggaaggattgtggatcaacggtaaaccttatgaaggcaagctaatgggaacaaaccggcatcaggattttgcagttttggggaatgctttacctaattctatgcaatggagggatgctaagaaacttcgtgatgctggcatgaaagtaattcgtacccactacgtgattgatcctgctttcatggatgcctgtgacgaattgggtttgtttgcattggttgaagttccgggttggcaattttggaataaagaaccggtttttagtgaacgtgtttattcggatatacggaatatgatccgcatacaccgtaatcatgcttctttattcttttgggaaccgattctgaacgaaacgcattatccggaagaattcgccaagaaggcattggatatttgtcaggaagaatatccatatccttatagtatcgctgcttgtgacaacggtgcggcgggagatcattattattccttgttgttacgtcctatcgaatcgaagttacgaacggataaaacctattttatccgtgaatggggagataatgtagacgactggaatgctcaaaattcggatagccgcgtggcacgcggatggggagaagtaccgatgctacttcaggcggaacattatgcgaatccgtcctacgtaaaggaatatccggttttatgctatgaaacgatctgcaacaaacccagccagatagtcggcgcctgtttctggcattcgttcgaccatcaacgcggatatcatgccgatcctttctacgggggaattatggatgcttttcgtcaaccgaagtcctcttattatatgtttatggcacaacgttctcctgaaaaaagtgatttgatcgcagataatggtccgatgatttatattgctcatgaaattactcctttttctcctgaagatgtgactgtgtattctaattgtgacgaagttcgtctgacagtatttaaagatggaaaagagtataagtataaaaaagaccctaaccataaaggaatgccttcacctattattacatttaaagatgtatttcattttatggagtggaaaacgatggctcgttccggcaaacagaatgatgcctatttactggcggaagggctgatcgatggcaaggtggttgtaagtcataagcgttatccgtccggccaagccgatcatatagcacttcgtttggatcatgaacaagtttcgttgaaagccgacggttcggatgtggtgacagtgattgctgaggttgttgataagcggggaacggtaaagcgtttaaataactcttgtatccgtttccagatagaaggagaaggacatatacttggagatgcttctgtgggcactaacccgtgtccgttgatctgggggacggctccggttttagtacaatcgacagcaaaccccggtaaaattaaaatcatagcctctatgcaaaacccgggtgaatcccgtccgttggaaggagttctggagtttgaaagtgtagttaatgaccaaaaggaaatctattcggaaaaagagctggcttcctccggacagccgtttgtcgtaacggatcgttctgtaaacaaaagcgatctggaaagagagaacgaacgtttacgtaaggaattaaatcagttgaaagtgaaagaagtggaaaaacaacagacgcagttcggtgttggcatcaatgactgacgtatcctgattttatgagcggaacatgctatatgataatattttttgtacctttgcagatcaaaaataacaggcaagctggcctatgtttaataaggatataataagaacaaaacaatatggaaattgcaagtaagtacaatcccgcagaagtagaggggaagtggtatcagtattggttggataacggctttttcaagtcgaaaccggacggtcgtgaaccgtatacaatcgtcattccgccccctaacgtcaccggcgtacttcatatgggacacatgcttaacaataccattcaggatatcctgatccgccgtgcccgtatgttgggtaagaatgcttgctgggtaccgggtaccgaccatgcatctatcgctaccgaggcgaaggtggtgaacagactggcacagcagggaatcaaaaagactgacctgacccgcgatgagttcctgaaacatgcctgggaatggaaagaagaacacggaggtatcatcctgaaacagttacgtaaactgggtgcatcctgcgattgggaccgtacggcttttacgatggacgaaaaacgttcggaaagcgtgttgaaagtttttgtcgacctgttcgacaaaggtctgatctatcgtggcgtgcgtatggtgaactgggacccgaaagctctgaccgctctttccgatgaagaagtaatttataaagaagaacatagcaaactgttttacctccgttataaaatcgaaggggaagacggttacgccgttgttgcgactacccgtccggaaacgatcatgggggatactgccatgtgtatcaatccgaacgacccgaagaaccagcacctgaaaggtaagaaggtgatcgttccgcttgtaaaccgtgtgatcccggttatcgaggacgattatgttgatatagaattcggtacaggttgcctgaaagtaactccggctcatgacgtaaacgactatatgctgggcgagaaatataacttgccttccatcgatatcttcaacgataacgggacactgagcgaagctgccggtttgtatatcggcatggatcgtttcgatgttcgtgcacagatcgaaaaagacctggaagctgccggcctgttggaaaaggtggaagcatacgaaaataaggtcggttattcggaacgtaccaatgtgcctatcgaaccgaagctgtctatgcaatggttcctgaagatggaacacctggcacagatcgctttgacaccggttatgaatgacgacctgaaattctatccgcctaagttcaagaacacataccgtcactggatggaaaatatcaaagactggtgtatcagccgtcagttgtggtggggacatcgtatcccggcttattatctgccggaaggtggttatgtggtagccgaaacacctgaaaaggcattggaactggcgaaacaaaagaatccggcactgacaatggccgatcttcgtcaggacgacgactgtctggatacctggttctcttcctggttgtggccgatctctctgttcgacggcatcaataacccggataacgaagaaatcaactattactatccgaccagcgacctggtaacaggaccggatatcatcttcttctgggtagcccgtatgattatggcaggttacgaatacagaggcgacatgccgttcaagaatgtttactttacaggtatcgttcgtgataaactgggacgtaagatgtcgaagtcattaggaaactctcccgacccgttattgctgatcgaacagtacggagccgacggtgtccgtatgggattgatgatggcagctcctgccggaaatgatattcctttcgacgaagctttgtgcgaacagggacgtaatttcaataacaagatatggaatgccttccgtctgatcaaaggttggacggtcgacgatacgattacacaaccggaagcatcggctacagctgtcaaatggttcaagatgcagctggataagacgatcgctgaggtagacgacctgtttagcaaataccgtctgagcgaagcgatgatggttatctataaactgttctgggatgaattctcttcctggtatctggaaatgatcaagccgggctatcaactgccgatcgataaggtgacttatcaggcaacactcggtttcttcgacgcgttgcttcgtctgctccatccgttcatgccgttcattacggaagaattatggcaggctctcgaaccgcgtaaggaaggtgaaagtctgatggttgcattgatgcctgaagttacaccggtagatgccgcttatctggaatcattcgagatcgtgaaagagatcgtgagcggtgttcgtacgatccgtttgcagaaaaatattccgaataaggaagaattgactttgcaggtattgggagatcataacgatgcttttaacccggtaatcgctaagatgtgtaacctgtctgagattgcaaagaccggcgataaggctgccggtgccgtatccttcctggttcgtaccacggaatatgctgttcctctgggcagtatgatcaatgtggaggaagagttggctaaattgcgtgaagaactgaaatatcagcaaggcttccttgcttccgttacaaagaaactgagcaacgaaagctttgtaagcaaagctccggccaaggtaatcgatatggaacgtaagaaacaagccgatgccgaaagcaagatcaaatcgatagaggagagcattgctgcattgacgaaataatagttaacaaaggacggcgggaagataatcgttcccgccgtttttttcttttgtattcatcattcaagtgttttcaaaatcaactatcatactatcatgattttagtatgtcatttgaatatcaatgattgtgtttatgatagttgcgcgttttaactatcattcaactatcataaactatcataacgacctgtttgaggtgtaagcatcgcaaaaaagaggattaaaaacgatcagatgcctgctgttttccgatagtaccctacatcttttgctcaaatatggctgttattttcacgaaaactacttattcttctccttgagatccccttttcaggcccttttacacccgggtttgaatgatgctgagacccggatcccagtaccctttacacccgggtctcagaaaagaaaagtccctactttgctgaaaataagtcatatacccagccggttttgttaggctgttttatgatagtatgatggttaaaaatggaactatcatacgaactatcatcgcctgtaagtattggatttcaatacgcgaaaagtcaagaatgatagtatgacagttctattggacaatatccgttcgtatataagatcaattcttcctggttttgagttgcccttgttttatttttcaagataaagcttatatatctttaatttttactaacttgcaggccttgttatttacaaggtgtataagaaatgagggaaataagaaaaaggctgttcatcatcttttgttttttaggaagcttttgtcttcctgttactttatgtggtgctaatgacatttcagatgcgctatctctcgattcgctttttgcgatagcacaggcaaatgtacagcaacaaaagggttttgagtatgccacacaattgctggaagaagcccaacgtcggaaggatcgctatcaggaagcgaatgccatgttctgttatgtccgttattattattccaaaaataccgacagtatgtatttctggatgcaaaaggcattacctctctttagggatcaaaagaggtttgtagagtatttccggatgaaagcatggtatatttatattttgaatcgttcgatgcaaaatgaagaagccctgaaatatgttgacgatttaaaggaagaagcgaccagtctgaattatcccgaaggagtagagatggcaaatcaggcacttgccgacttttatttgtccaataatctaggtgaagaaggtgtcgctctgtatgaagaggttgtacatagtatggaaatgagaaatgcacctcttatcaagcgtatcaatattatccggcaattgatgaataaagccttggatcccgaaacgagattgaaatatgttgagcggctggatgattacattaagatctgtaagggaaaagggatcgagtggttggatgatgaaatgtctatatattacctggaatatgtcatgcaccggcactatgccatggaatatataggaagggataaactcaaggaggcgttggctcacttgcaacaagcccgggcacttctgatgaaatatgggatgtataattatgaaatagagttgaagacaatttatggctcttattatcaacatagtaaacaatataacaaagccctggcgatttttgatactttattaccagtttggcgccagcggaatacgatggggagttatctcgatatgttagatcgtaaagcagatgttctattgaagatcggaagggatagggaagcgtcgcaactctatcaagaatatgcttttttgagtgattcattatcgaaagtccgcttttacgataaactggcggaaatgaatgcacaacataaggtagataaactggaaataaaaaacaaacagatggatctggaagttgcccaggcacattctcagcttcttcaaatgggagggggggctattctcctgtttattttatgttgcctgttggggtatatatcctatagtcgccatcgttacgggttgcagttgaagttggctaaagagaaagcagaagaagccgaccggatgaaatcgactttcctggctaatatgaaccatgagatccgaactccgctgaatgctattgtcggtttttcccaggtgttggtagatgaagatgatcaggaaacccggcaggaatatgccaatattatacaaagtaacaatgaactgcttcagcgtttgataacggatgtccttgatatatcgaagattgagtcgaatacgatggctttgaattatgcagtgcacgatcttcctgtcctgatgaaggagatctataatgtgataaagctaaggatgcctgaaaatgtaaaattagaacttaatgaatgcctgccacaatttttttatacagatcgtaatcgtcttacgcaaattcttactaacttgctgaccaatgcaatcaagcatacggaaaaaggttttatccgctttggttatgaggtgacagagacagatgtcgtcttttcggtggaagattcgggagaaggtatccccgaagataaacaggagaagatattcagccgtttcgttcaattggatgactggagtaaaggggtaggcctggggttagcaatttgtaaaggacttattacccagatgggagggacgatcggcgtttcttccgtgttcggtgaaggttcaacatttacggtcgttttacctctgaaaaagcagtaatatattatttacataatttaccatgaagaattctagaagaaacttttttagacaaggacttgccggcgctatattattaggttcggccagtgtagtaaaagccggtttgccggacaggatcattcccaaggcagccaagtcgattaatccctggcgattagggatggctggctatacatttgttaattttgatttggacacaaccctaaagactttggagagactggatattcattatctttgtatcaaggatttccacttgccgatggatagtaccgacgaacagattaaagcatttcatgagaaatgcgccgcacataaagtgacgggttatgcggttggtcctatttatatgaagagtgaacaggagatcgaccgtgctttcgagtatgcgaaacgcgtaggtgtaaagttgattgtgggcgttcccaactacgaattgctcccgtatgtggacaagaaagtgaaggaatacgatttcaattatgcgattcacctgcatggtcccgatattaaaacctatccggatgcaacggatgtctgggagcatacgaaagacctggatccgcgtatcggaatgtgtctggatatcggtcatgacctgcgtaacggttgtaatccggttaccgacttgaagaaatatcatacccgtgtgtttgatatgcatatcaaggatgtaacagactcatcgaaggcaggtgtcggtatagagatcggtcgtggaaagatcgactttccggcattaatgaagatgatgcgtgaagtgaactatactggtatgtgcagcctggaatacgagaaggatatgaaagatcctttcctcggtatcgcagagtcgatcggctatttcaaggcggtgagcgatattgtataatgtaggggcgaacttagtttcgccctcttttaaacagaagagtgatgagaagtgcgttttatttattggcaatcggcctgttgacgtcttgtagttcggtcaactatgtggcgattgaaacatacaatccggcagagattacttttccggaaaatgtcggtaaagtactggtagtgaataatgcagtgccgcagccggatgatgtcggttgtcagcttagtctgttcggtacaaaacaggatacctgtcatgtgaaaaccgatagtgctttatttgctacttgtcaaggactggggaaggcaatggtcgatgtctcttttttcaacgacgtgcttctttatcatgatgctacccgtaaggatgatgtgtattacgaagacaagaaactgacaccggaggaagtaaccgccttatgtgatgaaaccggaacggatgccgtgatctcagtggatcgtatgttattcgaaacacaaaaagatgtggttgcatttgcagaagggtatgtggccggtgatatcagtgtgaaaatgtcgggtgtgatacgtggttatctgccgggcagaccgaatcctttggcgactgtttacatgacggatagtcttttcttttcggaaagtgcctataaccaagtgcttttggatcatgtattaccctctatggatgatgccgcacgtgcatcgggcgagtatatcggtatgagagccagccctaattttgttcctcattggactcgtgaaacccgctggttctattccggtatgggagcgcactggaaagaagccactgcttatgcccgttcagagaagtgggaaaaggcagctgagcgctggcaacatctgtatgatacttccaatagctggaagactcaggcaaaagtagcatccaatatcgctttggggtatgaaatgaaaagtgagttgaaggaggcatacgattgggctaaaaagtcatacgacctgtttaaaaagaatgaaggcgaccagggtaagaacacccgtcttttatatctttatgtagaagcgttagcaaaccggatacgctcggataaaaaacttaatatgcaatttggagaataatatcatatattctccgaattattactacttttgacagacgattcaaaaagaataaaaaaagagttatgagtgcaaataatgcaaagattcagtctgtcctggagacaacctttacttccgctatcggaaaactgactgccgatgattccaatagctatcacagtgatttatatgtccaggctgaccctgaaagcggggagctgcaaatctatgacgaagaggaacggttgctggacaagacgatcgtattcgactgggtaggctgtccctgtgaagaagacaaattcaacaagcaggtagccaacaccgtgaaatcagtgctgactcttttagttgcgaaaaatatatttgacagtcctcacatcatgaaacctttctctgttagcctgacagatgaggatttcgttgtaatagaggaacttctcttcctcgacgatgaagttttacgtgccgacgatccgctgttgaaagatttagatgcagaattagatgattttttagccaaacttctttcagatgtcgaatagagtttttacatttgtgcccgaattgaaaaacaagtaacaagtaaatatataatgttgccgaaatagctcagttggtagagcaacgcattcgtaatgcgtaggtcacgagttcgagtctcgttttcggctcacaaaatcaagcagttatctttttagataactgctttttttatgtttttttctatggttttcatgagtcatgtaaacagggatgtaatctcgacgatattgttggttatgcttgtactttataattaggttaaaaattagggagattattaaacgccttttctttattaatttcgcaaaacagagacattcgatatttcaaaggatagaaaaaaaacaaataccatagttctggtagaactatttttgttttcggtgcaaaaatacatattatttttaaataaccaatattttaacagtttaaatatttaattattttaaatagcttgatgagtataattaatatttgacaaaacaattcggctaattaaattaaatcttcctgttctatattttatataaatgaattgtattgtaattgtttataggttgaagattaagggataagttctaccagaactaatataaaaacaaacataaatataatctgtgtcaatacactaaatcttttgattaacataagttattccttatagttaacctagttttaataattaaaagtaatgctatgctaaaaaaaatgcaaaccgttggtgttttgctgctttcgttagccttttcttatgggggacagcttcatgctctggaagtgaatgcagcaacaactattactcaacaaacagacaaacttacagggactattgaagatgagttcggacctgttacaggtgcttctgttgtcgtaaaggggacgacaaatggaactgttacggacatgaatggaaactttgaattgtctcatgttaaaaaaggagacttgatccaaatctcttttatcggttatattacccaggaggtaaaatacacaggacaaagccctattaaagttgtacttaaggaagatacacaaacacttgatgaagtggttgttgtcggtttcggtacacagaaaaaggtgaatttaactggttcggttagtatggtggatgtagaagtgcttgaatctcgtccggttcagaatgtatctcaagctttgcaaggtgttgttcccggtttgaacttttcagtaaattcaggtggtggtacgcttgataatgaaatgagtttcaatattcgtggtgccggtactattggcgatggttccggttcgaaaccattagtattgattgatggtattgaaggcaatatgaacactgtcaatccgaatgatattgaatcggtttctgttttgaaagatgctgcagcttcttctatttatggttcgcgtgcgtcgttcggtgtaattttaattaagacgaaaggtggaaaagctggtaaaaccagcgtaagttattctggtaatcttcgtttcacagatgctttacagataccggaaatgatggattcttatcagttcgcacaatattttaatgcagcagcagccaatgctggtcagagtccggtatttagtgctgatgtcatgcagcgtattcaggattatcaggctggtaaaataaaaactgtttctactcccaattctcaaaataagtgggaaatgtatacaggtgctaatgctaatacagattggtttgctgaagtatatcgtaactgggcgccttcacacgaacataatttgagcgtaagtggcggtacggaaaaattgacttaccgtgtcagtggtagttttctggatcagaatggtttgatacgtcatggatcggataatttccagcgatatacattggatgctaaaatatcagctcaattggcaaaatgggttactttaaattatacaagtaaatggacacgtgaagattatgatcgtccgacttatatgacgggattgtttttccataatattgcccgtcgctggccgacctgtccggtgtatgatgacaatggacatttgactgaaggtatggagttgacccagatggaagaagggggtgtacagacacagcaaaagaattattacactcaacaaatgggtttaaggttcgaaccgatcaaagattggacaatcaatattgacgggaatatgcgtacgcataccaacaatcagcactgggctgtgttgcctgtttatgcatacgatgccaataaccaaccttatgccataagctgggatggcggagcttcttattcaccgggagcgagtcgcatttcggaaagcagatatacagaagattattttacaacaaatatttatacggattaccagaaaacaatcaataaccatttcttcaaagtgatggtcggatttaatgccgaattgacgagaactgataatctttatggacaaggtgataaaatcatctcttcggaagtacctacgataaatcaaactacatctgaacaaaaagtgggtggcggtaaggctgaaaattcagttgccggtttcttcggacgtatcaactacaactacaaagatcgttacatggttgagctaaacggacgttatgacggatcttcccgttttataggtgatcagcgttggggattcttcccatctgtatcagccggatggaacattgcccgtgaagaattctttggtgatctgtctgatattttcagtacattaaaagtgagaggttcttggggacagttgggtaatacggatacaaatgatgcttggtatccattctaccaaactatgccggtcggaacagctagtggccgttggttagtaaatggtttgaaaccgaatgtagccggattaccatctatcgtaagttctttgaagacttgggaaacagtagaaacctgggacgtcggtttggattgggctttactgaataaccgtttaaccggatcatttgactactttacacgttatacgtatgacatgatcggaccggctcctgaactaccaagtgttttagggacaactcctccgaaaatcaataactctgatatgaaatcatacggttttgaattggaactgtcatggagagaccgtatcggtgaagttagttatggggctaaatttgtattgtcagatgcaagacaaaaaatcaccagatacccgaatgactcaaggtcattggatattgctcattacagcggtaaaatgttgaatgaaatctgggggtatactactgtgggtattgctcagactcaggaacagatggatgctcatttagctaacaataaaccgagttggggatcaagctggagccccggtgatgtaatgtataaggatttaaatggtgatggtgttgttaacacaggtgccaatacggtagataatccgggcgaccgttcggtaattggtaatagtactccgcgttacaatttcggtttgactcttgatgctgcttggaaaggttttgacttctctgtattcttccaaggtatcggtaaacgtgactattggttggatggtccgtatttctggggggcaaacggtggtatgtggcaatctgccggtttcaaagaacactgggatttctggcgtggtgaaaatgatccgttgggtgctaatttgaatgcttattatccgcgtgccagcttcgatggaagcaagaaccaacaacgtcaaagtggatacttgcagaatgcagcttatatccgtatgaaaaacatacagttaggttatacattgcctcaacagtggacttctaaggctggtatgtcttctgtcagattgtatatttcgggtgataacttgctgactatttctgatattaccggagtatttgaccctgaaacattaggtggagattggggagacggaaaattgtatccactgtgtaaaacgatttctgtaggtttgaatgttaatttctaaataatgaggattatgaaactgaatttaaaaaaaatatatatatttcccatagcagcagctttcgggttattgacatcgtcatgtaacgatttcctggatagggaaccggtttctagcattacgcctgcacaatattttaattctgctgaagaattgggagcttatgctatcaattattatacctctcttattgcaacaaatgatgctgcgtataatgccgggcctttaaatgttgacggtagtacagacaatatggtagtaggcgaagccaatacaggctattttgctgcagatcgctggttggtaccttcttcaggaggtcccgatttcagtctgattcgtgccatgaactacttcctggaacaagtattgccaaagaaagaagccggtactatatccggtgcaccggaagatatcaaccattatatcggtgaaatttattttctgcgtgctaccgcctacttcgaccgtttgtgcagttacggagactttccgatcataacaacggtaccggaagataaaaacgaagagttagtggaacttagtaaacgtgcccctcgtaatgaggtcgctcgttttatcctggaagatttggataaagccatttctatgttgaaaccgggtacggcattcaacaaagtacgcatcggaaaagaaatggcacttttggtgaaatcgagagtagctttgtacgaagcgacatttgaaaaatatcacaaaggtacgccacgtgtaccgggtgaagccggatggccgggagcagacaaagcttacaatgcgggtaagacattcaatattgatggagaaatagatttctttctgactgaagcaatgagtgcagcgaaagaagtggcagacaatcatagcctggtacaaaatacaaaagtattgaatccggcaatcaaccagatttatggatggaatccttacttcgaaatgttttcaatgcctgatccaagttctttagacgaagtgttaatgtggcgtcagtttgattcagacttaagtataacacacggtttcatggcctatatcatggaaggtggtaataatggtatgacaaaaagttatgtagacgcattcttgatggaaaacggtttaccgatctatgctgccaattccggatataagggtgacgtaacgatcgaccagcaaaaagaaggacgtgacggacgtttgcaattgttcttgtttggcgaatcaacggttttagtcaatgaagattctttagagctttttgaagcaccgacggttgtaggtttgaccgaacatcgtgaccgtaccggtttccgccagcgtaaacactattgttatgatttctcgcaaatccgtaatggtgtacgtggaacgaatggtattgtagtagcccgttctgcagaagcttatttaaactatctggaggcttcttatttgaaaaacggatcaatcgatgcgacggcagcctcttattggagacagttgcgcgaacgtgccggtatagatccggattttagtaagactatcgctgctaccgatctttcaaaagaaccggactgggcagtttactccggttccgaaaaagtagatgcgactatgtataacattcgccgtgaacgtcgttgtgaatttatcggcgaaggaagaaggtggagcgacttgatccgttggagagcattcgatgccttattccctgaaaatatgggtaaatacattcccgaaggtgtgaatttctggacgcaaatgtataaggatgaagcttatttgaaagtagatgagaaaggcaacttgactaacgaatccgccttgatcgaacaggctgaaggtaaaggtgatgccaacatctcaaaccggaacgacagcaaatatattcgcccataccgcgtaatcaaagagaataatgaagtttgggacggataccagtggagaaaagcttattacctatcgccatattctgttcttgaactgacattggcttctcctgattcaaaattggaaacttctaatttgtatcagaatccttactggccgacaacagcaagctcaccggctttggaataatagtacattcaacataatttaaataaaccttaattaccctgcaagtattcgagagaactcttgcagggttttctttatggaagatccgaccaacttttttctgcaatggatgccagacattggaataatatttttttgttgtctttggagtgttggatatttgattcccggataatatcttccacttgaaacggtagattggaggtaacccctttagttggaattgttccgcttgaaattgtgacctttttggtttgagcatataagatcatgttgtccgtagttttttgtcctgcagttggaattacatcataaagctcctgtatgaaatgcagcctgtttatttttaacatggccatacaatcaatgagttctttgagattatctttggggataagattaaatggtgtatacaaaactacaacccgatctttatgtcggggaccgtctaatatggtcatcccaggcacactccatcgaatattttttaccggcgtaggactgttaatggctgaaggaagtaaaaaatgcaacgtttgcatggcataaaagaaacccttttgtccggatgcttttaccaaaatacaagacggacctatattcagtttgtagtgctcagactctaactctttatctgtatggaatatgatatctgcttttttgttttgaatagtcactttaggagtaaatccggcagcaagattgaatagactggtaaattcttgcgctattgctgcctgtttttcgttttctacactgatgagagtcgattcatcgaatatgaaatcacccttgtctgatacactttgttgaggaaaaggaataatttccggcttttcattgggtaggatatatttgattaataccgcaaccacaaggataaaaaatacaccaattctgcgaaacattgataaataacctttaataaaacactttgtttaatttttacatgtcgcaaatctatattttcagaatatttctcaatgttcgatatcattcagaaaaactcagaaatcgttttttgtcttctgcaaggcttgcttttcggatgattttgtatttttgccggacaaagggtgaaatatgattatgcaagtattcaaaaattatttacaattatatttattcttgttttttgtattcttaacagggaagctttgtgcagcccccaggtattattttaaacagatttcattagaaaacggcctgtcgcaatcctccgtaaaatgtgtattggtagatgacaggggtgttatgtggatcgggacccggtttggtttgaaccgtttcgacagggaaaagatcacagtctatcaggaagagaaaggtaacccatattctcttccttataatgatgtcgtttttttagaacaagatgccaataaaaatatctgggtagggaccagtcgtggggtggcgcgttttgatcgtgatgcccggaaatttctacatcaggaaatagacggacagccggtggtggcatcttgtagccttcttctaccggaaggaatctattttttaggaaagaaaggtattttttattattcctatgaggaaaaggaaattgttcggtgcgaattaaaggttccctttgtatcttctcctaattatgcttatttgtataacgaaaaagaaagaaaggtcatactctcttttcggggaaacggtctttggtggtattatccggacacaggcgatatggagcggatatcatttgttcctgaggggaatatatcttcgttgtatgtagattcgctcaagcatatttgggtggcagtctataataaaggagttttttgttatgatgacgaggggcgattgatagaacatctggaagctccggataggttgagtcataatgtcgtgcaggatatgcgggaaaaggacggtgaactttggatggcaaccgatgggggaggtattaatatttacaattataaggataagtcggtaaaaggaatcatgcacctctccggcgaccggcattcccttccggtaaactcttttgcctgcctgtatattgacgaagaagataatgtgtgggcaggtagtatccggggtgggctgataggaatcaagcctgtttttatgaccacctatcgggatgcgcctcccggagcttcatacggactcagttttgagtcggtcacttctatgtatgaggatcgggatggaaaaatttggatgggaacggatgggggaggcctcaatcgatttaatccgaaaacagaaacatttttggaatatcagcagacatcgggaatgaaaattgtttctatcatgccttataatgattcggatttgctattatcatcatttggtgacggactttatcgttttaataagcttacaggtgaatgccatgagttccggctcaattgggagaatgttcaaaaagacttgtttacacgtggaaatgcggttcggctgtatgctatagacgaatatcgtttctgccttttatctgataactatctgtatgtgtacgacgcgcgtaaacagcaattcgaggctttacctgaaggggcacttccaaatttagtagctcctcgttttgtgtcgggcgattcatgttatgtgagttcttccacagctttgtatatgtttgatattctgcataaacaacttcatccgatatttgtcgcagggaaagatatcggaacaatcacttctgttaaacaaggcaaggataaacgtttttggttgggaacctcttccggattgtatgtatatgactctactctgcaaaaattggacacggtcgatacgaagctatttattggagttatgtctcttgctttcgatgatagcgatcgcctttggataagtaccaacgatggattatatgcatgtgttcctcatgagaaacgtgtagtcgttttcggagaatctgatggggtttttacacgtgagtttttacctcagccggctttaaaagttacttccggtgatatttatatttcgggcgtggaaggcgttgtaaggatacgccccaaccaggaatttcaaaaggaagaagatttttccgtcagcctgataaatctggccctggatggttctcctattcatcccgacggaatattcggagagcaggctatctccattccttgggattattcaactttggggctaagtgtcatcgtcaaagaaaaggatttgatgcgaaaaaaactattccgtttttatatcaaaggagaccgggaggatttgctggagacgtccagccatgcatattcattgccctccctggttcccggcaattacgagttgtgggtttcatacagtaaaaggaacggagactggagtaagcctttgaaattgttgactgttaatgtaataccgcctttatggctgcgtgtgtggttccagatattagtgatttttatagttttgggagtcgtgggatgtggagcttggttggtcatgaagcgtaaggaacgcgagctcgttttgacaatgaaagaacatgaacgtaaattttacgaagaaaaagttcgtttcatggttaatatcagtcatgaactgcgtacgcctttgactttgatttatgcacccctcaaacggctgttgaaatccggtaaagtgacagacaaagaggtctcccgtcaactggacggcatgttgttgcaaaccagccggatgcgtgaaatcgtagatatggtactcgatgctcagaaatcggacacgaatggtaatgtcatggatatccgtttttacgatctcaatgactggctaagggctgtaacagatgattttactcccgaatttaaagcccgtggaatttgcttggaatttaagttggatgcaacgatagaaaaagtccccttcgatgcagccaaatgtcgtgtcgttttgtccaatttgttgataaatgcgatgaagtttagtgattcgaataccttgttggctatcactacggagcgtgtggaaaaaaatatacgtatttctcttgccgatcaaggtatcggattggctcatgttgatatggaccgtcttttttctcatttctatcagggcgaccacaatcgtaaaggcagtgggatagggctggcttatgcccgtaaattagtagagttgcatgggggtagcatcggcgcttataacaataaagacggtggagcaactttctatttcgacttgcctatggtacaggtacttgtgtcggaagagccggatgtggtaattgcaagcgcaacggataatggcatagcaacgaaaagaaatgtatgtgatgcacaagccgataaatcgctttctaaatatacattactgatagcagaagatgaacctgatttacgaaactacttgtctagtgttttacaggccgactttaagcaggtttatgtggcggaagacggtgagaaagcctgggaactcttggggcaatatcagcctgatctggtagtcagcgatgtcatgatgccccgtatggatggttacgaattgtgccaccggatcaaaaacgatgtgacggtcagtcatataccagtggttttgcttacagcccgggccgatcaggcaagttcggtcgaagggtataaatccggtgcggatgtatatctggcgaaaccattcgatgtggattccctgttggtggtcttgctgaatatattaaagcaacgcgatcagctccgcatacgttaccgccagtccggttgtctgttttctccgaaagaggatgctgtaagtaatgcggatgaacaattcatgcaaaaattgaatacattgattcatgaaaatctgagcaatccggatttgaatgtaacctttattgcatccgggatggcaatgagccgtacgacactttacagcaagttcagccacttgtcggatatttctatcggcgactatgtaatccggttccggatggtagaggcttgccgcttgctttcctcctataaagaaatgactattcaggaggtggcagaccgtactggtttttccagttctcgttattttagtacggcttttaaacaaagttacggtatgactcctacggaatatcgtcgtaataataaattttcatattaacgttcgatgagtttgctccctctatcatcactggcatagaaaatacttggtaattgttcaaagtcggcatctattcccgcttcttttaaaactgtttcgatatctgaaattgattgtagacaggagcggtaagcggttaccatgggccataagggctcctgttatgctagaaccgataattactatatctgtatccagatttttttgttcaagggattgtaataatcaaaaaagaggatttttgattatccagtaaggttgtcctgaatgtaagtccatagttatacgtttttcttattgttgaattttttactttttgtttccatactattgtttttgggagaaaagttgaaaatgtattatttatgtatattgaaaatctttcagtttttcttgtaattgtttgcgtgcgaaaaaaattctactttttatcgttcctaaaggtatattgagcttttctgcaatttcattatatttataaccatttaaaaataaagaaaatggaattttcacttcatcgttcaattctgtaatagcttttgtgatttcctgaatttgatagattttgtcaggggaaccagaaatattatcattgactatattcagattgtacaggtctgtatcttgatcaatcctagtctgtatacgtacaatcttatggtagttattaataaaaagattgcgcattatagtcataacccagcccgtaaaattgacattgtctacaaatttctcttgattatccagtactttcagcatagtgtcttgtaacagatctagggcatcatccctgttagcagttagtttgatagcgaagttcatcatgtgattttgtagtccgagtaatttttgttgaatttgtattctgttcataatacttgtttttgttaatatttttttttctgtcgcaaatctattttttaagttaattatattgtgttcgattttgtgcgaaaagattccaatattgttttttattccgttatggcttatatatcggatgattttgaacattttctaaacaatgagttttaatgattatgtgaaagtaacttactatactctccttggtcaaattaaattattagaatcatgtacaaaagtcacttgttttttcctgttatcattaaccatgattagttttgcctcgtgtagtaatgatgagatgtagtctgttcgcaagttgtatgagattcaatttatccaataagtaacacggaatatattaaaactgcaggacccattatatctaccctatggggacaaagagctttttataattataaaatgcctaataattgttgtaaaatttgatcagtctcttaatcttccacaggatgtgttgctgttgcagtagttcaaataatggcatattatcgttatttttcaatttacaattataatgattgtttcgaatgattctatgtgggagaataaatatgatgaataatggttgtaaatgctttgtctttaattgttttctccgagaaataacgaattttttatttctgtatgcttgaaagttttacctttgtcctgtaaatcatcattatctatatgaatatatgaatgaaaccattctgaacggtttattaaatctgtttgctgtttttgcttcggcggtgcgcatcgaggaacagcaggcaagccgtgcggttcatttttatttgtccagtcattttggtgttcgttctcataaagagtatattgagttatacagtgagttgcggagtatgtacgatgatcctctttttccagtggataaggagggagtggtacataatatctgtgagcagatgaaggtgaagctgatggcggaagaacaacttcttctcctgatccgttttgtggagtttgcttattccaatagtgaagagtttgagaaccatctgtctctttttcatctggtggctgatatttttgccattccacaggaagagtttgatgacatacttgcatttataatcgggaaaccgtcttcttctttacttcttatcagtggagaagagactgaagctgaaaaccatataacccgtaagggaatggacggatttatccgtgtactctttatccgtcggttcgataagcagatatttacctattatggctcaggggtcgttttcatgaacgatatccctttatcatcgggaatattttatgcctggcagcacagtagcgtattgaaggggcctttatttcttccggtttattacagtgacttattgactgtctataataagaatgaacggaaagaaacgatttctctggctggtagaggtttgaattttacttttaaaaatagctccaacggactgcataacttttcattcaacctggagtcgggacaactggttgccattatgggaggaagtggagtcggtaagtctactttactgggtatcatgaacggtaatatccgcccggacgaagggactataaccgtgaacggctatccgttggatgctcctgaagcccggcaactgatcggttttgttccgcaagacgatttgttgattgaagaacttaccgtttatcagaacctctggtttacggcccgtctttgttttgcccgtctctcggatccggagattaaagaacgggtcgatacggtcctgaaagatttggatctggaaggtataaaagatctggaagtcggttcgcctatccgtaaaacgatcagcggcggacaacgtaaacggttgaatatcgctctcgaattgattcgtgagccggctattctgtatctggatgagcctacctccggtttgtcttcgtcagattcagagaaagttatcatgctgttgaaggaacagacccaccgcggaaggctggttgtcgtgaatattcaccaaccatcgtcggaaatctataagttgttcgaccgtctttggttgttggaccggggagggtatcctatctatgatgggaatccgatagaagcgattatctatttcaagcaagcggccaaatatactgatccggatatcagtgtttgcagtacctgcggaaatgtcaatcctgaattgatattgaacattatagattcgaagaaaatagacgatagcggtaaccagacgaatatccggaagtttacccccgaggaatggcatgagaaatatgtctcggcgcgaccagcttacaccgttgccgaggagaaagatttacctgacagcaaacagcggaaaccttcctggtttaagcaattctgtattttcctggaacggaatatccgaacaaagttggttaataaacaatatctggcaatcaccttactggaagctcctttattggcattgattgtcgctctgcttacccgttatgtggatggtgacgagtatactctgcttgccaataagaactttgtgtcttatatctttatgtcggttattgtcgtgacctttatggggttaagcataagtgccgaagagattataaaagacaagcctatcctgaagcgtgagcattttcttcgtttgagccgcagtagttaccttacttccaagatggtctaccttctgatagtatcgggactacaatctttgctttttgttttagtggggaattttatcattggagtaggatgggagatgttcggtatctggtggagtatcctttgggctacctctttcctggcaaacctgacgggattgatcttgtcgcagtcgatgaattctgttgtagccatctatatcacgatccctcttttgcttattccgcagatattactttgtggattggtgatcaagttcgatgacttgaatacccgtgcatcgaaggaaaataaagtgccgctgatcggtgaaatcatcccttcacgctgggctttcgaggccttgatggtggagcagtttgccgataatgcttataaccaggcttattttccaatcgaaagagaaaagtatctggcacagtattatgagaatatacatgcgaaagaggtgcgtcggctggctgaacaactggaaataaaggatgattccgacaaacgattgacgatagaaaatgaactggctgtgttgggacgtgctgcccgtattgccccttatgcgaagggcgaaagctatctgtcgtatttggataaggtggatacggctctgcatgaacgtgcgcataactttactgcttatctggatcaggtgcaacaggaagatatacgtgagaaaggagttgagtgggtaactgcccaaaagaaagaacaccataattctgctatcgaagatctggtgatgggagcgggtggacgtaatttctataaagagtacggccatcgtatttatcctgcgataggtcaaatatatgtagtgccggataacctgtatggcagagctcctttctatgcttatgagaaaaacttgggtggtatttcaatttctacgtataattttaatttattgattataggtttctttgcatttatagcgattatcgctatattcgcagagtttccgggacgttttctgagagaagattaaaaaagctggaatataaattattaaataaagtaacatgaaaaagagtgtattaagcgtgcttgcaatagccgcattaatggtaggcatggcttcctgtaatggaactaagaaatctgatgatgcccagaaaacggaagaagctgccgttatagccggtaaagctccgaaagatttgttgacagaagaggtaaaacaggaaactgttaagttcctggctgatatgccggagtctgagcttccttatcgtttgtcaagcggcgaagttcaggttaaagtggctgatttgacatatatgctgccggtagctaaagctgctgaactgagtactgctacacagaaagcacgtgcacttggcatgtatatggctgattacaacgtattgaaagctatcggccagcctactgctgaggtagaaggtgccatcgtaaaactggctacagacctgaatgtttcttttgtattggatatcctgaaagaagaagctccgaaagatgcaactaaagagcaattgcaggctttcatgaatgcacaggaagataagatcatcgataagatggctgcagaaaataaaatagatgtacagatcgaaattttaggtgcatcttctgctgaatatgcttgtctgcttgctaatcctacattggttgttaagggggatgctacatctgccggtttgtctgccaatatggaaaaacgtgtgactatgctggaagaagtagttgccgacctggcttcttattatccggatcttcaacagctgggtacaaccatcagtcccctgaaagaaaaagtaacaacaatccaggatgccagagctgctaatgcagaaatcatgggtatccgtgatgctttgctgaaataagtacatatatataatgtatataaaaaacggagatgtaccgatcggtgcatctccgtttttttatccgctaaaagaaaattagccttgatacgtgatggacaacaacgtgatgtcgtccgattgtacggctccgacaacgaactttcctaccttctctgttattttatcaacgatctctttcggactctttccgatcaactcctgacagttttcaagtaaccgttgttcactgtattgctcgtggcgggtattcatcgcttctgtgattccgtctgtgtagagcaacaggttgtctcccggcaatagctgtaaagtcttttcgtgataggtgatatcgtctatgcttcctaatataaagtcgtttgtcagcggtacggatacaactgtattatctgctttcatcaggacaggagggttatgtcccgcattgcagtaggtcacgagaccggtattcaggttcagtatgccatagaatacggtaacaaacatttcatttatattttcctgacaaagaaatgcatttgaacgttgcatacacatggctgctgagttttcgttcaatgcgattgtccggataactgtccggctgatcgccataaagatggcggccgggactccttttcctgcaacatctgcaattacgaatcccaaacgatcctggtctatgcggaagaaatcgtaaaagtcgcctcccacatatttagccgcactcatataggcgtagatatcgaatgacttcagttccggaaacggcggaaacgttttcggcaggatggtctgttgtatttcctgggcgatatgcaagtcattacggatagactccagttgtgagtgttcctgttgtgccttcttgatgaaggatatctgttcggctgccttttcgatcgtacgttccaggtcttccaggttgattggctttgtcgtaaagtcaaatgccccctggttcatggcactacggatattctccatatcgccgtaggctgagaccatgatacatttcagagctggattctgcatctcgtttattttggcaagcaatgtcaacccgtccatttccggcatgttgatgtcacttaatataacatcgaaatccggttggacaagcatgagttggagtgcttccagtccgttatgcgcaaaatagaattcatattctcctttctttatcttgcgacggaagtattgggtaagcaacctttccaggtctaattcatcatctacacttaatatttttatagccatgacttttgtctctgttattgttggataggaatagaaatggtaaaacgggtatattcgccgggacaggactccatctcgatcgtaccgttgtgtttttgttcgataatcgatttagtgatcgataaccccaggccggtaccttctccgatcggctttgtagtgaagaaaggagtataaagtttcttcttaacctcttcggaaataccctgtccgttatcttctataaccagggcgatacggtcgccttctttctttagggaaaccttgatagtgggctggtaagctgtgtcggctgcctctttcgacttgctgaatacggcataacaggcgttgttcatcaggttgagaatggcacggctgaagtcttgcggtataacctttaccaatggcaagtcgtcggcataattctcttgtatagctacgttgaagcttttattattcgctctgacagcatggtaagaaagccatatatattctttggtcagctgttgcaggtcggttgggatatattcgtcgtctttgccacgcgaatagagcaggataccacgtacaatgctcgaagcgcggttgccgttttcttcgatcttactcatattcccttccaggtcagacataatttctttgatctcttcgaccgagtcttccggtaatgcattcccgagctcgtccagcacttcctgcatatcctttagtaacttctgcgaaactttgctgaaattgattacgaagttgagtggattctgtatctcatgtgcaataccggcactcaataatccgagcgaagccatcttttcctgctggctgatctgcttccgcagattctcaatttctttttgggtattctcattcattgttgatccttttttgactgatgggaattgtaattaggaattcagtatagttatccttttcacttttcgccaggatcgaaccctgatggttaaggataacttcacggcagagatacaacccgacaccggctgcttcagccgaaggtttcgttgtaaagaatggttcgaatatcctgtctttgatattgtcttcgatacctattccgttatcgtagatactgataaatgcagtattgttcgctctttcctccaatttgatcgtaataaacggagtgaaactttccttctggagtttacggagcagtgcatagataccgtttttgagaatactgcctattgctttattcatctgttcgatatcgatttccactataagcggcttttccgggcattcgagatttatctgtatctggttttcttcaatttcttttttgaataatttgttgagaacatctatgttgaccttacacaactcgctcagatcggtcgctgtaacatcgccgtgacggtctttcaacaactcttccatagctttgacgatgcggacagtgttacaaccatgctcattgattttttgcaggttgccttctatcatatcaagtatttcgacactgtcttcataaatctcttttgtcatgacggctcgctcgtccgtgatgttttctttcaattccttgatcaggtctgccgataggccggcaaagttattgatgtagtttaccggattgaggatgcggtctaccaatccctgtgtaagctgtcctacggttgccagcttctctttccgtaccagttcgtcctgcgcttcggccagggcatccagtgctttcgacagtttttccgattctttcaatacctggtcgcgctggatacggagctcgatggtacgttcttccactattttggcaaggtattctttttgcttcaactttttccgcaaacgtccttttaagatatagagaataatctctacaacgatagcgatgccgggaaccgtttcccaatcgtaataaaggcctgcaataataagtatccagccaaccagcgtcaacttttctatgatgcgcagctgtcttttgagggaagctatttctttaatatcgaagtcggccatatcactgaatttctttggtcattgttaatatattctttccttcggaacggtcatacctgacatccgtcatcaattgtttaaccaggaaaatacccagtccgccgatcgggcgttcttctgctgaaagggtaatatccggttcctgattttccagcggattgaatcggatgccgttgtcggtcacgactattttcaacagtccctcttcacaccccatgtcaatgcgtatatcgccttctgaattgggatatgcatattgaataacattcgtcacagcttcgtccatcgccaactttatctgtataagcaatgttgcatcgataccgcaatgtccagcctgctgctccaggaaatcatacaggagggcaagctggtcgggattattcttaatatgtagtgtgctggtcattttaccggagtttggatcttattactcgatggtaaggaaagagttgaatccggttattttgaatatatccataatgctgctctggatattcctcaacacgaaagttccgcctttcaggctcatctttttttgtagaatgagaagtaaacgcaggccggcactgctgatataactaaggtcagtgccatcgagtattactttctttacatctttctcaaggatgtccatgatctctttttccaaatcgggcgaactcaaggtatccagttggccggaaagactgatcactgtctctgccccgtgttttatttttatttccatatacttttcgctttcaatttaagcaaatgtaaatattataatctgacacagcaagttattatcttgatttgttagttccggcttacttctttgtaagccggctgattccgcgtgcaatttcacctacccagagaaccagggaggaagaaccgatgatgataccccagtctttcaacgatagaggaactacattgaacatttctcctccgaaagtaacgatcagatactggccgataaggatcagcaatgctacaaacaggaaacttttgctctctttcaggttggagaaagccgaacggccttccatgaacgctttggcattgaacatattccagaactgaagcatcacgaagaagctgaagaaccaggacaggtcgtgcggagttaatccggtctgtgcgtggaagtagtataatactcccatcaggatgatgacgaaagccaaacctactccgaagatgttgtaagccatcggacgggtgatgataaagtcgccgtcttttccgctacgacgaggtttgtctttcataacccgttcgttaggaggaagggaggccagtgccccggctgcgaatgtatccatgatcaggtttacccacaacatctgagtaatggtaagcggtgattcggttccgaacagcgagcctaataatacgatcagacaggcagccacattgattgtcagctggaagagcaggaacttctgaatgttacggtacagggaacgtccccacataacggcgcgggtgatacttccgaaggagttgtccaggatcgtaatatcgctggcttctttagcaacggatgttccgtctcccatcgaaagacctacctgtgcagctttcagggccggagcgtcattcgtaccgtcgccggttacagcaacaacggctcctttcttttgtaataactggaccaggcgttgcttgtcggttggacgggcacggcacataattttcaggtcgagtacacgatccaatgcttcttcgtcggttaaagcttcgaaacccgggccggtgatgatgttgcggtcggtatcttccggtttccatgtcccgatctgacggccgatctctttggctgttcccggtgtgtctcctgtcacgatctttacatctatgcctgcgttcagacagctttgaacggctgcggggacatctgcccggactgggtcggagatagcaacgattcccaggtaagtcaggtcggttccatgtaagcgtccgtttacgaaataagcttcgtctttcccgtcttcaatgatctggtaagcgaatccgagtgtacgcatcgcctgattctgataattcaatagttgcttttcaatatcggccttgcaggcttctaccggcttgtattctccgccggtcgctacacgccggctgtttgtcaatacgatttccggagcgcctttgacgtataatatctttttaccgagcaagccggactgtacgacagttgccatatactttctttctgtcgagaaggtgagttgtgccagaaccggtgcttcctcccgtaatgtcagatagttctggccttggctgttcagccagagcaacagggctgcttcggtggggttgcccaatgtctttactttatcttccgagaagtcaagataggcggtagagttaaccgagataccttctttgatcaggttgcttagttcatcgtcacccagtttctggtcttttaggttataaaagtttgtctgatagacctgcatctggttttgtgtcagtgttccggtcttgtcggtacagatcacggttgttgctcccattgtttcacaggcatgcatcttacggaccagattgttcgtcttaagcatccggttcatgctgagcgcgaggctcagggttacgctcatcggcaaaccttcggggacggatacaacgatcagggttactgctatcataaagatattcagtatgtgagagatcaaatccattaccggcataccggaagaggtgaggaacagtttgaccaatagggcgataaaggtaagcccggctacggtgtatccacctttactgatcacggcggcaagccctttcagttgcatctgcaacggggtctcgacgtcactttctatttgagagccttcatatacttttccgtatccggtagcgtcaccaaccagttcgacctccatcacaccgtgtccgtctactacggtcgttccacgcatcacagcgttggatgggtaagttgcttcgttatcgaattcagcttcgttggtcgttttgctgatgatcggttcgccggtcagggtcgactcgttaacctgtaaggaaatagcttccagcagtcgaccgtcggctggtatttcttctcccgtttccagtacgacgatgtcgcctactaccacttctttttttgtgatctggcagatatttccttcgcggattacttttacgaatgtatcatcgttcactgtgttcagtatatcgaatgctttgttggctttcagttcaaaaaagaaccctacacacgatgccagcatgatggcaaagaatataccgatcggttcgagaaaagcggtgaagccctttgcctccggtccccagcaatgtacaccggcgatgatcatcgacaacagccatgctaccaacaggatcttaatgatcggatcattgaacttctcgaggaactgactccagagagaagctttctcgggaggtgtaaggatattttcgccgtgaaggcgcctgctttcttcaacttcttgtttggttaagccctgatactgatgtttcttctccataaatttgtttattccaattcagaattataatgtacagcaaattacgtaaagttgacggacatacgcaagtgctttagtttttaattgataatatttgaacctattcgctccgatgaatcctgtgcggaggtctaaattgtcatatatagtgaaattggagtatcataatatatgatacatctttgttctctcgagtcgtttaacggttttagttgactactttctgtgttataaatgaggttggttgtctccggtttatcatcctataactttgttaaccttttgttgtgttaaattaacgagtctgacttaaacttttatcatcttataattgtcttatacatagaaggcaaattgtgtattagttattaaggttatgaagaacgttaggttattctggatactggggattgtcctcgttttaacagggcaatccctttgtgcccaaaccaagaaggaaaagaaagaacaaaaagaaaaagaagtaaaagaattaatagaatgtaaacggtttacgatagatgtgaaccgtgcgatacccatgggagggcgttctctcaatctgacctctccctattctctggaaatgcgcggcgactcggctatttcctatcttccttatttcggaagagcatattcggctccttatggtggcggtgacgggttgcgatttgaaaaatcaattaccgattatcaaacctctttcaacaaaaagggaaccgctcaaatacagtttcgtgcccagacagacgacgatacatatacattcaatgtacaggtattctctaatggttctgcaactataaatgtgacacctgtcaataaacagaatatcacattctacggggaactggctcctaagaaaaaggaataaatagtcgtccctgccgtgcatttctttcggcaatacgcttatttactttagcggtaaactcgaagtttttaagtccccagtcgggagcgatcaacagctctttcggggattgcgatacaaacctctctactacaatagaggggtttaatttttctataaagtcgatcaccaggtcgatgtattcgtcggccgtataaagatggaactcttccggatgatcggcatattctttcgccatgcgggtgttgcggatcagttgcaattgatgaagctttagcgtagtgatcggtaatgcggataatcgatcggcatgatgcagtatctctttgcggctttcccccggtaagcccaggatcagatgggctccggtgtagatgcctctttcggctgtccggcggatggctgtttccgattcttcgtaagtatgtccgcggttgatgcggatcaatgttttatccaatgtactttccaatccgtattctatcatcacaaacttttctttggagagggcggtgaaataatccagtaaggcttccggcatacagtccgggcgcgttccgacgatcagtccgaccacttcgggatgcgataaggcttcctcgtatttggctttcaatgaattcagttcatcgtatgtattggtatatgcctggaaataggccagatatttcatttccggatatttgcgggagaagaagcggatgccttcttccaattgttcggatacgcttttttctgtatggcaatattccggactgaatgtctgattattacaataagtacatcctccccaacccttggagccgtcgcggttagggcaggtgaaaccggcgtttatagagattttctgtactttgtaagggaattttttccgtagaaaatcaccgaaatcattataaggctttacgttttccatgaggcaaaggtaatttataatggttaatcaccaatgtccggtggttaatttaacgataaaatgcccggacttacctgggctggtacataaattacctttaaaggtgaagggtttaccatgataaaatgctaactttgcggcctattcaaaataaaattagaagtattcatgaaacgattgggtgttggtttcttgctttcattggcgataattggaagcgtatctgctcagaacgggagcaaacgtgtagatttaaaagaaattacagatggtaaattccgtcaggtaacggctattggagagatgcggtcgttgcccgatggtgagcattatacagcaatgaacaaggatcggagtatgatcattaaatattcatatcgtacgggtaatccggtagataccttgtttaatgcccgcactgcccgcgaatcgacatttgatgacttcgatggatatgatatcagcagtaccggtcatcatatattggtttggagagagactgaaccgatttatcgtcgttcgttcaaggcaaccgtttacgattatgacgtgcgtcgtaactacgtaaagcctttgtcagactcgaagaataaacagatgattccgacttattcgcctgacggacgcatgtgtgcttatgttgtggataacaatatatgggttcgtaagttcgattacgatactgaagtgcaggtaaccaaagatggtgaactgaataaaatcctgaacggtattaccgattgggtatacgaagaggaatttgcagttacaaacctgatggcctggtcgcccgacagtgagtacctggcttatgtccgtttcgacgagagtgaagttccggaatattccatgcagatgtacggtaccggtttatatccgggttattacaactttaaatacccgaaagccggagaaaataactcgaaagtaaccgtgcattcttacagtgtcgctactaaagatatcaaggaactgaaagtgccggttgaggcagatagctatatcccgcggattattttcacgactaattccgaccagttggctgtaatgactttaaaccgtcagcagaacctcttcaatatgtattatgtaaatccgaagagcggtgtatcgcgcctgatccttcgtgatgaaaataaatgttatgtagattccgaatggttgacttctatacatttcttcccttccggatttacttatgtaaacgaacaggacggctattcccatatttatctgtattcgccgacgggtgtaatgcagcgtcaggtgacaaaaggaaactgggatgtaacccgtctgatcggttacgacgatgcgacaaaagtcacttattacgaatcggcggaagaaagtccgttgcgtcgttctgtttataagatagatgcgaaaggggtaaaaacgaagttgacagatgcagaaggaacgaacagtgccgacttcagtgataactttgcttattttgtaaatacctggtcgaacgcgaacactcctgcccggattacggtaaacgaaacaaagagtaaaaaagagttacgcgtattgcaggataatgccgctttgaaagaaaagctggctaatacgtcgttctctaaaaaagaattcttcaaggtacatacagcttctgattatgagctgaatgcctggatcgttaaaccggtgaatttcgatgaatcgaagaaatatcccgtgttaatggttcaatatagcggtcctaattcacaacaagtattggataaatacggttttgactgggaacactatctggctgctaacggatatatagtagtcagtgtggatggccggggaaccggtgcacgtggtgaagccttccgcaaatgtacatacttgcggatgggtgaattggaatccagagaccaggtggaagctgcacaggcattaggtaaattgccgtatgtggatgccagccgtatcgccatctggggatggagctttggtggatacaacacattgatgtcgatgagcgtaggtaacggtactttcaaggccggtatcgcagtggctcctccgacagactggaaatattatgactcggtttacaccgaacgttttatgcgtacgccaaaggaaaacttctcgggctatgctgctacatcgcctatccgtctggcaaaagacttacaaggtaagctattgctggttcacggtactgctgacgataatgtacacttccagcaaacgatggattatgcagaagcattggtacaagctggtaagcagtttgatatgcaggtttataaagaccgtaatcacagtatttacggtggtaatacccgttatcatttgtataccaggatgtctaatttcttatttgataatttataatgccagaacatttgagaaagccggattggttgaagatccggcttggagggaacgaacagttcacacggactaaaagtattgttgagtctcattgtctgcacacgatctgtacaagcggcaaatgtccgaatatgggagagtgttggagtcgtggtaccgcaacctttatgattgccggtgagatatgtacccgttcctgtcgtttttgtaatacacttacaggtaagccgttgccattgaatcccctagagccggccaatgtggcagaaagcattcgcctgatgaatttgaaacatgcagtaataacatcggtcgaccgggatgatttgccggatatgggagcccggcattgggtggatactatccgtgcgatcaaggaggttaatccggaaacaacagttgaagttctgattcctgatttccagggacgtcttgatctcgtggatatggttgttgctgccggtcctgaaattatttcacataatatggaaaccgtacggcgtatcagcccgcaggttcgtagtgctgccaaatacgatgtcagtttatctgtcctgtcccgcatagccggacagggagcaacagcgaaaacaggcatcatggtcggtctgggggaaactccggatgaggtatgctgcctgatggatgatgtgcttgctacaggggcttccatattaacaattggacaatatttacaaccttcaagaaaaaatattcaagtttccgaatatgtcacccctgagcagtttaagtattataaatcaatcgctttggagaaagggttccgtatggtggagagtgctccgctggttcgttcctcttatcacgccgaaaagcatgtttaattgcgaaaacatttaacaaattgcgttgttatataattaaagtgcgaagaaagggggaaagggtatgaacaaagttaagaaaggattggacaaccaagccattggcttattgccattgctgttgtttatgtttttggacaattacttttcttatctgttgtctttcatcattggcgttaccttttgctttgtatgtatttttctctatcaggtcttaagtaaagataaggtgtatcaattcctgctgttgccttcggcaatgacgctcgtgttatattctatttttctttgcttgaaactcgagccggttttgtttatttattctccgttgattacggaagtgttgttggttgttgtacttgcgtttatcggttttacccggcgctcggtactaaagaaaatacgaacatcagctcatccgacttataaacggactttaatgcggacaacattgaatgaattttatttcattgcccagcttgttcagaatttatatacattgcacctgtttgccattctggtatacagtatcctgccggatacaatgcagagtgtacatacagagcgtttcctttacagggaactgggggtattggttggtatacttgttattctttatgaacaggtacgtttgtcgttgatgcaaggtagtttacggaaagaaatgtggttgccggtgttgaatgaaggaggaaaagtgattggttgtattgcacgttcggtaagtcgtacgctgccaaagaaatactaccatccgatcgtccggatagccgttattcataacggaatgctgtatttgatgaaaaggagtaaagatgctttcgtgtctcctgatacgatcgattatcctttccatagttatgtgttattcaggcatagtattgaaagtactgtgcgtgagtcggtgggcgaactggccgaacaggaggatgtaacacctcgtttcctgatacgttatacgttcgaaaacgagaaggttaaacatttagtttcactttatgtgatctgtcttcgtacggaagagcaactgagtcaatgtaaaaaggcaggcggaaagttgtggactgccaaacaagtagaagaaaacctgcattcaggtgtattcagtgaatactttgagcaggagttctcttatcttcagaatacgatattgctggctgaaaatttctgctgtggaaagtaatagacttactatcgaataccgagttctatcacttccaggtctttaatattcttaccatcaataacaaaacgtacaagcgtacggacctggtgaaagccgctctttccggcggctcccgggttgatatataaacaattaagatatttatcataagcaactttgagaatgtgcgaatgacccgctatgaagagattcgggcgggtatcgtacaattctttacggatagccgggttgtatcgtcccgggtagccgcctatatgcgtcatcatcacatttacttcttctactttgaaatgagccacttcgggatattccaaccgaagtgattgcccgtctatatttccatatacggcccggaaaggtttcaaggctgccaatcgtgccgccagtccgtccgatcctatatctcctgcatgccatatttcatcgcattctgcgaagtattccgcatatttatcatcccaccaggcgtgagtatccgagagaagtccaactttaatcataacaatttcttttattctacaaaagtatctatatttacgcagctaagaatagaatacgatggagaattcatataaatactttaaacgcgacatcagttggctttctttcaactaccgtgttttgctggaagcggaagatgatacgctgcctgtttatgagcggattaagttcttgtctatctattcttccaatctggaagaattctatgaaatacgtgtggccgaacaccgcggagtgatcatgaaaaagaacttcaccgaagaaagcggtgccgaagctgaagaagtgttgactgagataacgaatgaagtgaaccgccagcaacgggaatattaccggatcttttcggaaaagatattgcccgaactacatcgacagaacatttacctgtatcagggaagcgaaccggaacctttccatgaagagttcgttcataacttctttaatgaggaggtcttccctttcctgtcgcccgtaatgatacaggccggagatatccgtacgtttatccgcgaccgccgtttatacctggtgatccgtatgataaagaaaagcaagcggaaaccggaagagggacaagctcctgaatatcattatgccatgatgaagataccgtatgccaaggttccccgttttatcgagttgccggagcatgaagggaagttctatatcatgtttatcgatgatatcatccgtgccaacctggccaatatattccccggatatattatcgatagctgttacagtatcaagatatctcgtgatgccgatatttacctcgagaacgagaagggaaatatcgtggagagtatccgtaagaaagtgaagaaacggaagatcggtgacttgagccgttttatgtacgacagggcgatgccggacgatttcctttcttttatctgtgatgcgttcggtattactgcggatgatctggtggtaggcggtcgttatctgaatttgcaggacctggccaagctgcctaatccgaaaggaaaagagctggagcagcagatcccttcccctatgcgtattccttatctggatgaaaagggatcggtgttccgtgccgtgaagaagaaagatatcatgttgcatttcccttatcagtcgttcgactacctgatccggttcctgatggaagccgctttcgatccgaaagtagacgagataaagattacccaataccgggtggcggaaaattcggcggtgatcaatacactggtcagtgcggcacaaaacgggaagaaggtaacggtctttgtagagctgaaagcgcgtttcgatgaagagaacaatatgagtaccgccgaacggatggagcaggccggtatacgtattatatatagtatccccggtttgaaggtacatgccaaagttgccgttatcatccggaaggactctgaggacgggaacaaacgccgtgactttgcttacctgagcacaggcaacttcaacgagaagaccgcccgtatctattcggatatggcattgctgacttgcaacgacgagatcataaccgatataaacaaagtttttgctgtattggaagggaagatggccgaaccgaccttccgccatctgttggtggcccgtttcaatatggtacctgaactgaaacgtatgattcaacgtgaaatcgatcatgtaaaggagggacgcaaaggacggattgttttgaaaatgaacgggctgcatgatcagaatatgattaatgagctttatcgggccagcgagaacggcgttgagatcgatctgattgtccggggtatttgctgcctggtgcccggtcaaccgtacagtgccaatatccggataacccgtatcgtcgatatgtttctggagcattcccgtatctggtatttctataatgacggtcgggaagatgtcttcctgacatcggccgactggatgcggcgtaacctgaaccgccgtatcgagactgcctttccgatactggtgcccgagatcaaacaggaagtcatcgatatcctgaagatacagatgcgcgataatgtaaaggcttgcctgatcgacggacagttgcataacaatttcaagcgggatgatgcctccgaaaaggtacgttcgcaactggctatttatgagtatctgaagaataaattgtgaatgaactgatatggacaatccttcttccctgacctttttccttttttgcttctgttgggttgcgctgatagccggtgcggtattggggtacattatcggtatccgtatggcacgtaacaaggagcgtcaccggctggtgaaggaaaagatcaggaagaataaggtggccatttatcagtatcagaaagagaaatacgagtacatcgagcagatcaaccgcttggaagaagacctgcataacctgacggaagagtcggaactctataaggagcgcgttgccgacttggaatattatcagcggaaagtgcgtgaaagcgagcaaatcatcgaacgcctttcttccggtgcattggaggtcctaggagggatgtccgatgctttctcccttgtaatgcaacttaagaaagatcccgtgcgcaccaacctgaccaaacaggaatggacggaacttttgcacactaccgatcttctcttcaacaactttctcactgagttgaaagagaaatcgggtatcacccgccatgaagaggagatatgctgcctgattaaatggaactttgcacgcaaagaccagatggctgtcttcaacaacacgaccgaagccctgaccaaatcgaagagtcgcctgaagaagcgcttgcaactcgatgaaaagaccgatctggatcagtttattcgactttattaatcattctgccggtagggattgtcttgcaaaatggtggaaatgttatttgtgtttgatttatatcgctgataattatctttttatcgtttatagtatttgtccggtatctatcctttcccttctcctttttctcccctacatttgtcggagtgaataattaactctgataatatacaaacaaatgaagcttatgagaacacaacatctattagccttttgtctgttgggactccttacattggctggttgtaatacctcgatcgtagagaaacgggctaccggattaccttacgaagtcctggtggttatggataaaacagactggaacagtgaggcaggagacatggtgaaggcccagttaacctcaccggttcccggacttccccagccggaagcctccatgcgtataacctactccccgaaagaaacgttcgatggtttgctgagatatgtgcgtaacatcctgatcgtcgatatcgatgcaacgaaatatacccaggtatccttgagtaaaagcaaagacgaatgggcgacagggcaggaggtaataaagctcagttccccttcatccgaagagttggtcacttacctaaccctgaacgaagccgatatagtcaatcatttttcgaagatagagaaagagcggcgtgtggcaatcctgaagaagaattacagccaactggccatggataaagtacaggaaaagttcaatatccggctttgtgcaccggacgatatgacctacttcaaagacacaaccgactttctctgggtctccaataatgccaagacgggacgcatagacctgttggtctactcttttccgtacacagatgcgaatacatttacggaagactatctggtagccaaacgcgactccgtcctgaaagtgaaccttcccggtgctttccccaattcatatatggcaacggaaacacgtgtcggcctgtcttatgaaccgataactttgaataaccggtattgcggcgtattgcgcggtttgtggaagatggtgggcgataagatgggagggccgtttgtcagtcatgcctttctggatgagagaactcagcgtatcgtcgtaacggaaggccttgtttatgctccggagacaatgaaacggaatctgatacgtaagattgaagcggctctttatacggtgaatatccctaagccggtagtagcccgagcgtattgacccttcgggagcaaagaccttagttgtcaagagctatctgcttagtggccgggatataaaataaccttgtccggcaggtaaccgctacggatacgccattcctgggggtaaaggttattggcacggttaccgagatgcttgacaaatcctagcgggaagccgttgtaacaaaccaatacataacctttcttcgtatcttcgggcaggagcaaaacctcttttttcaggtatttgacagcatcttcccaactgatttcaacggaggtgaaggcttctctgttcaacgccgtacttaatgccagtgaatgggctggcaggatgtctttccctttcagctcgccgatgcgtattccggcagtgacgatccggagctgagcagcaagcagttgccaggtttcataatgagccgatggaatggcctgtatggtatcattgatcagttcgaagcggaacttgtctatttcctctatccaattatttacctgagaagggacggctggtgaggctttccctttttctttcttatttttatttttgggacggatctcattcgtatcaccgggtgctttgcgtaaggcggcaaggaagaaaccttctcctttggtcttatgcgggaagaagcggtagaccggatgatcgtaacgcagtgcgcctgcgatctgccattcttctttaacagggatggtcagggcttcggcccccagttcttccaatatataatgtatgttgtcctcgtcttcttccgtattgtatgtgcaggtgctgtatatcaataggccgccaggtttcagtgcgtcccatatatcatggatgatacgccgctggcgtgaagcacaaaggttcacgtttgccacgctccactcgccggtgctgtcggtgtctttacggaacatgccttcaccggagcagggtacatcggtgacgattacgtcaaacaaatggatgagacggcctatctcttcgggatcgttattcgtcacgatattgtttggattaccccatttggtgatattctcggccaggatattgctgcggctgcgtatcacttcgttgctgaccaatagactgccttcgggcaagatacttaatagatgggtggatttccctcccggtgcggcacataggtcgagacatttgaccggctcgctgacgaaggtacggatggcttgttccagaaacatggaagaggcttcctgcacgtaataagctccggcatggaacaacgggtcgaaagtgaacgataggcgttcgggtaaataatatcctgtttcgctccaggatacccgtgaagtctccggtgctttcgtccctttctttgggttgatacggatacttacgggaacatctgcctgcaatgcggcttccagtttctcatattcgtcgcctaacaaggcacgggtacgtgtgataaaatcgataggaagtgccatcttattctgtttgtttggtgcaaaagtactaactttgcagaaaactaacagtatgcaagcatcgcttttccttataccggttacattgggggagactgaacatcgtcgggttcttcctgaatataaccgtgagatcatccttcagataaaacattttattgtagaaaatatacgtactgcccgtcgtttcctgaaaaagacggagccgtctatcgttatcgacgacctgactttttatgaactgaataagcacacctcaccggaagacgtagcgggttatctggctccgttggcgaaaggggagcatgtgggcgttatctctgaagcgggatgtccggcggtggccgatccgggggcggatgtcgtagctattgctcaacggaagaactatccggtcgtgccgttggtggggccgtcttccatcctgatgtcagtcatggcttccggtttcaacggacagagttttgccttccatggttatctgcctatcgatgcgtcggagcgcaccaatacgatcaagaagctggaagggcgtatctattcggaaaaccagacgcagctttttattgaaacgccttatcgcaacaataaactggctgaggagctgatccgtacttgccgcccgtcgaccaagctgtgtattgcttcggatattacttgtgaagatgaatatatccatacccgccctgtaaaggattgggcaggaaaagtgcccgacctgagtaagaaaccgactattttcttaatctataaataatctcttatggcaacttatcaggcacacgagacagcagtgatcgatcccggttgtacgattggcaacgatacccgtatctggcacttctcccatatcatgtcgggttgcacgattggtgaacggtgtaatatcggacagaacgtggtgatatcaccggaagtcgttctgggtaataacgtaaaggtgcagaacaacgtttctgtttatacgggtgtgacttgtgaagatgatgttttcctggggccgagttgtgtgtttacaaatgtaatcaatccccggagtgcaatcaaccggaaaggccagtatatgaaaacacatgtcggcaaaggggccacgatcggagcaaatgccacgatcgtttgcggacataacatcggggcgtatgccttgattggtgccggagcggtggtcactaaagagattctgccttatgccctggtggttggcaatccatccaggcaggttggctgggtgagtgagtatggacatcggctgcattttgacggggatggcttggctgtctgtccggaaagcggggagaagtatcagttgaaagataataaggttgttcgtatcggataaaaatagaaaaggcggaatcatccgccttataaatatttcttagcaagccttcaaactcatatcgagactcttaaccgaatgggtaagtgctccgacagagataaagtcgacaccgcattcagcatagtcacgcaacgtatcgaatgtgataccgccggatgactctgtctcgaagcgtccgccgatcatttcgactgccttctttgtatcttcaatattgaagttatcgagcatgatacggtcgataccacctacgttcatggcttgttgcagttcgtcgaagttacgtacttcaatttcgatcttcaggttcttgcctttttctttcaagtagttctgtgcgcgggtaatggcctgttcgatgccaccggcaaagtctacgtgattatctttcaacaggatcatatcgaaaagtccgatacggtgattaacgccgccgccgatcttaacagcatctttttccatcatacgcatacccggtgttgttttgcgggtatccaatacgcgggttttggtgccttccaatgctttaacatatttacgggtggttgtagcgataccgctcatgcgctgcataacgttcagcatcagacgctctgtctgcaatagggattgtacttttccttctactgtaaaagcaatgtcccctttctttacttctgcaccgtcattaataaagatagtcatttttagttccgggtcgaagtcatggaagatacgttttgccatctctacgccggccagaacaccatcttctttaatgataagctggctctttcccatggctgtttcgggaatacagcataaagttgtatgatcgccgtcgccgatatcttcggcaaacgataatttaattaagtcgtcaattaactgatccatttgttattctattctgattgattgtataatcgctttgtcgccgtcggcacggtaagtgatgttcacacgatattcgccagaggctgtcggaagtttaccgacaaagaaaccggcatcttttttatctgcgtggtgaactacggaaaaacctgtaggtttattgctgccaaagaacgtagaaagcatcttaacagcttcgcttccattgcatttcttggaagagccgggcaaggcaatgtctacttcctgatccatcgctcctgtcagtgaagaggcatttcctcctttgaaggcatttgatataggagtaatatcggccgccatgacgctcaaaaatgagagtatcaatgccaatgtaagtaataatcgtttcataagctatctcctctttttatgagttttctgatgcaaaggtatgtatttttcctgtaaattagcgccttcaatactaataatgtaaacgaatgaaaattgcactggtcgtaataggtaaaacggatgccggctattttgtggaggcaatcaatgaatacaaaaaccgtttagtccattacatcccatttgaaatggaggttatcccggatataaagaacgtaaagaatttgtcggaatcacagcaaaaagaaagggagggagaactgattttaaaggcgttacaggctggcgatcaattggtcttgctcgatgataaaggtaaagagtttacttcgatgcaattctcagcttatattgaaaggaagatgcatacggtttcgaagcgcctggttttcgttgtcggcggcccttatggattcagtgaggctgtttataaagccgcttcagaaaagatctcattaagcaaaatgaccttctcgcatcagatgatccgtttaatctttatagaacaggtttaccgggcaatgacaatcttgaataatgagccttatcatcatgaatagttgaccagtgacagttgacagataagcttcgcattcgagtcccaaactgtcaactgtcactggtcaactgttttactctcttgtcttttggagcaacagataatctaataatgtcattgccgtcatcgattccacaatgggaacggcgcgaggcaggacgcatgggtcatgacgtccgcgagctttcaggatagtatcttctccttccatatcaacggtttcctgttccataaggatggttgctaccgatttgaatgcaacacggaaataaatatcctgaccgttggaaataccgccctgtatacctcctgaattatttgtacgggtattgatgtgcccattgtcgttaaagaaacggtcgttacgttcggaaccgcggtaaagagcggcattaaacccgtcaccgtattcgaaccctttcactgcattgattgttagcatggcgtgtcctaaagccgcatgcagcttaccaaatacaggctctcccagtccgacaggcgtacctttaaccacacaggtaattacaccaccgatcgtgtcgcctttcgacttcacttctgctatcagtttttccatttcggcggctttctccggatcgggacatcttactgcattctcttctgtcagattcagatcataatctttataagtaccatccagtttgatagggccgacctgtgaggtgaatgcctgtatatttatacctgtctggcgtagtgcaagcttggcgattgcgccggcaacacatcgggctatcgtttcacgagccgacgaacgtccaccacctttaggatcacggataccatacttcatttgataagtatagtccgcatgtgaagggcgataaaccgttttcatattgtcgtaatcagacgaatgctggtttttattccagataatgaatccgatcggtgtaccggtagtctttccttcataaactccggataggaattgtacttcgtcatcttccttacggggggttgtgatctttgactggccaggtttacgacgattcaactcttgctggataaagtctgtgtccaactcgataccagccggacatccatcgataacacctccgatacccggaccatgtgactcgccgaacgaggttaatctgtatatatttccgaatgtattcatattaataaatgaaaagtggagattaaaaaatgagtctgaaaatgaaaaatgaggaatgcagaatctctattaattcttcattccccattctgcatctttcatttatttattagtggcaactaccacatccgcaaccaccttcgtgatcgtggtcaccgcaatcgcttccgcagtcatcgcatccgcaaccgcatccaccggccggagctgataatgctgcaatttcttctgctgtcggttcgtgaacatcgataacttcaccgctgaagtgtaaagtttcaccagccaacggatggttgaagtccataacaactacatcgtcttttacttcaagaacagaaccgttcagacggttaccgtttgaatccatcataggaactgtgttaccttctttgatgacttctgagtcaaatttaccttcaacttcaaaaatgtttttcggcagatccaatacatgatcttccacatattctccgtatgcgtcggcaggagcgatagagaagtcgaacttgtcacctacttcaagacctttcaaagcatcttcgaaagcaggaagcatggcgcctgttccaaagatgaattttaagggagcttctgcaactgctttttccatcaactcgcgctcttcaccttctcctacgttcaggtcgtatgtaaccgcaacgaacttatttgctgtaattttcatttttaattgtatttgtaataaataaaacgagacaaatttacgtataatttccgagtttatcaggttattcttttaaaaataaagatatgtaatgttttaatctgtaatatatagctatctttgcagccggaataaaagaatttgcggattcggaattatatagcgaataagtagtgtttgtcgataagttataaagtgatagttacacatgtgtttttctaaattgaaagactttttctttccatgttgtgaggaaagaaggaggttgataagtttatttttctttttattggtcctgaaatttatgtggtttaatttgctttggtgcatgttatctacgtttactcctttctcgaaggttgaaacatatcttggtactctattggtgtccttatttttattattgccgttagtatgtttccggacagtaaaggtgacattggttatcttcgtattgatggattgcctgttcatagccaatctgatgtatttccggacttattttacagcaatacctttagacagctatctgttggcggcaaacttaactgatttctcaagtagtgtgtccgattcgatgcgaatagcagatgcctttttccctctttcaacattgttttccggagtcttgtggtggcgatactatcgcgaaaagaaggaagtccagcctgttaacggggataaaacaccttttgtatttgtacgttatatttgtttgatattattggtgtctttatttcccgccattaagctttggagtcaaaatggttttaaggccgcctacgagagattgcaggatgcttaccttcatacatgtaatataccgatgtatacgatattcggttccctttattatgattattcatgtgataacatcacatacactcccgaaataaaaaatcgtatcgactcctggttaaccaggagaacggattataaatccgttctcccaaaagtttatacaagggagaattgtattataatcttagcagaatctctggaaagttgggtgttgaataaaactgtagaagggcaggagatcactccaaacctgaaccgtatattaaaggattcatctgtaatctatgctccccatgtcttatcgcaggtaaaaggcgggcgttctatcgatgctcaattattggtcaataccggacttttacctataagctccggtccttatagtataaagttcccggattcatattacccttcactggcaaaagctttcaaaaagaaacacaaagatagtgaggcttatagtctgacggttgataagccgatggtctggaaccagtgtgtaattactcctgcgatgggatacgatagtctggtttcgaagaactgttttatcaaagaggagccggtaggttcccgtggacaggtgggcgatcgtgcctttttgcgtcagtgtttgaagaagatacaaaataatgaagtctggaatgaatcgggaaatacgtttctgcagtgcattacttattccgggcataatccttttcttttgcctgactctctgaaaaaggtattcttttctcccgaagttccggaagttcttaataattatatgaccatggcgaactatacggatcgggcactaggggagtttgtaacacaactccgtgcggacagccgttttgataataccttggttatgattatgggagatcacgaagcgttaggtactgtgaggaaagagctttgtaatgatccggtagggaaacagattgtttcagataaatcgtttgttccgctgataattctgaatgcccctttcaacttgtatcatggaaaagtgatggggcagatcgatgtttaccctacattactggacttattggggttgaatgattattggtggagaggtataggagaaagtatactggattcgcacaaagcgaattttgaggtcgaccctcagttgaatatagtgggagatactactggagttcctgaagaggatattaaagtggcaaaaaaggcttgggaaatatctgatatgattatccggtacgattatctgggccatgtgcatgatcaggataaaaaagcgggaatagcagctgtcaagtaataaaaaagcaggttcgttatgaacctgctttttatatttattttttatcgatggcttttttcaaagcatttaatgccgtatccagtatggagcgtggacatccgatattcaatcgcatataaccttccccaccgggaccgaacatacttccatcatttaacaacaaaccagctttttcctgaaagagtttgaccagatcttcctggcttaatttcagatcacggcaatccagccagacgaggaatgatgcttgtggtggatatactttaatcttcgggagttttgctttgaagaattcgtcgacgaaacggacattttccattatatacatccgcatttgttgcaaccattcggcaccataggtataagcggcctctgttgctgtataagcaaagatcgtaccgtcgcctaactctccggcttccagaaattcatagaactcctttcttattttttcgtcaggcacaatagaataggaagttacgatacctgctatattgaatgttttacttggggccatgaaagtgatactgcaggaagcggcagcttctgatacggtcgcaaacgggtgatgactgaattgtgggtaagccatttctgcatgtatctcatcggagattaccagaatattatgctttgcacagatttctgcaagtttgactaatgtgtcttttttccagacaatgccacccgggttatgaggattacagaggatcaatattttgcattgtttgtcgatgacagattcaagatgttcgaaatccatttcataaacgccgttcaccagttttaacgggttattgacgacttcacgtttcatactttctggaacaatgcggaaaggatgatatacgggaggttgtataatcactttatcgccaggtttggtgaaacattggatcacaaagccaatacctttcacgatacccgggatgtagctgagccattcccgtttgattttccatttttgtttataatctacccactctataatactttgatagtaagaatcaggtccgaaagtgtagccgaatatttcgtgttcgcaacgctttttaatggcatttacaataaagtccggtgtccggaaatccatatcggcaacccatagaggagtcaggttctcattgccgtaccgctctttgatcgcatcgtatttgacgcaattggttccgcggcgttcaataacttcgtcaaagttgtattgtttcattttatcttagttcagtcagtttttcttagtttgtcgattgattggggtcaaagatacaaattattttatccgaatctttttattttgatatttctgatattttttgctacttcgcgttagttatggaattaccaggggaacaacatatcttgaaggagatcgcaaaagggaatataaaagctttcgaacagctttttttctgctaccaacctaggttggtatacttccttgtcggcctgacgcacgacaaggaagtcagtcgtgatatagcccaggatttgtttctgactttgtggaaagaccgggaaaaactgaaagatgtccgttctttttcctcctatctctttcagatggcacgctttaccgtctatgattatttcgaccgtcttgctgtttctgagaaatatacgaatgagtttttgttggaggcttccatctcccaatcggaagaggaggtgctgtttgcgcgtgagttgcagggtattatcagccgtatagtcgaacagatgtctccccaacgtaaattgatttaccaaatgagccgtgaacagggcttatctaatgatgagatcgcaacccgcctgaatatcagcaaacgaactgtcgaaaatcatctgacggctgcactggctattcttcggaaggtactttatcttttcttcctcgtttgtttagaataaaagtctttatttcgaaaagagtttcactatggagaaacaactgtttcatatatgagaaacaagtgtttcacttaggtggaacaaaagtttcaactaaagaaaatgattgaaactttcagaaaaactttttttaggttgtgtgtatccggccggttaacctacattcttataaaggcggatattttatgaaagaaaacaacaatacaaaacaactcatgcggctatacttcgggaaacatttttcccgatatgggtgtattttgtttggacgttggttgaaggcagatgacgagaagatacaaaaggaagagatgttgcaggagttatgggaaaaatcacagccggaagcgacagcttcaacctatagtgactggggcattttgcaaagacacctttccgcaactcctgctccggaacattcagtttcattgtatcgccaatggttaaaatacgcagccgttattgctttaatgattatgactgccggaataacatactggacaaccgatcgttttaaaccggcccgtcatgtggaaatggcgcagatatttgtcccttacggagaaagtgaacaagtggtattacctgacggctcgaaagtctgggtagatgcgggtacgttgctggtttatccgaaagattttaccgataccgatactcgaacggtttacctgagcgggcaagcttcattctttgtccggaaaaatccggaacaaccgtttattgtaaagacgacttacctggatgtccaggctctgggcactgtgtttaccgtggaggcctatccgggcgattcctgttctatggcaaccttggaagaagggagtgtcttgatttccgtaagggatgaaaatattcagccaacaattctgaagcctgatcagcaattagtctattcacattcggaacatacggtaatggttcattccatcgatgcttccttatataatatggagagaaatggttatctgatatttgaaaatgtctcttttaatcgtttgatggcttctttggaacgtaagttcaatgtgacgatccattataattcccagaagtttgcaggggaacattataatgtcaaattctcaccggatgaaaagctggaagatgtgctggatattctgcaacaattggttggtatacattataaaataaaagggaatgtggtatttataaactaaaatattggagagaacaaatatgaacaaaagaaaaccggaaagacagaaagtgcgaaaatccctctttccggaattcgaaatcgaatcttgaacatcattggattgacgagttaatcgtctggttttattaatattcaattttcaaatgtacaaatatatgaaattaactaatctaatacctataaatagcagaaaaagtatgtccaaactgttatttataacagctttatctttttacagtctattttcttatgcgcaaaatcaacaagtgcgtttaaccggtaataatctaacactaaagactgcttttaaacagatcgagcaacagacgaaattgtttgtagactataatactcaggaagtaaatgattcccgtctcatttctaaattacctaaaaatagtagcgtgaaagaggttatggaacaattgctggaaggaaccggctgttcgatagcgtttagtaacgggcatatcattattactaaacaagcagcagttgttccttcaacaaaaaaaatttccggtattgtaaaagatgaacgaggggatcctgttatcggagcaaatgtcgtggtgaaaggaacgacaagtgggactgtgacggatatgaacggacaatatacccttgaggttcctgctggtgccgtgctgcagatatcttacataggttataatacgcaagaagtgaaagtagggaatgtaaatgttgtaaatatttctctccgtgaggattccgaagccttggatgaagtagtggttattggttacggtacggtgaagaaaagcgatttgacaggtgctgtcggttccgtgcaaatgaaagatgtgagtcaggtgggtataaccagtgctgatcgtgctttgcagggacaagttgccggtgtacaagtaaatgccagaacaggtcagccgggtgaagcaatgatgatccgtgttcgtggtagtaattctctggcaggaggtaatgaaccgctttatgttatcgacggtatgccggtagagagtatgaactcggatattaatccggaagatattttatcgatggaggtattgaaagatgcatcttctacggcaatttatggttcgcgtggtgctaacggagttgttatgatcacgactaaaagaggtaatacgggagagacagtactcgattataacggttatgtaggtatttccatgttaagaaagaagctgaatctgctgggaaaagatgattatatatcaatggtgaatgaggtttcgaaaaatgatggaaacggtatcgcaatcacgcctgaagaagccgcttcgttgcctaatagtgattggcaggatctggcttatcaaacggcattaacgcatagtcatcaggtctctgtttccggtggaactgataaaacaaagttgtattcttctttgaattatatgaaccaggaaggtattatcaaaggttctgactataatcgttttgctttacgtatcaatggcgatcagaagttagcgaaaaacctggcgttaaacgcaagtatcgcttattcatacggaactcaaaatacggcaaatagcagtgctgatggttggggggcaattgcttacaccgcaatggtaatggctcctatacagccgatcagggatgctgatggaaaatacacgactttctctggaactccgtggggagggactaatcctgtagggatggcggaattatataaaaataaaacagtgaattcccgtttgctggcaaatatgtcacttgtctatgatattatcgacgggcttactttccgggtgaatgccggtgctgaggtaaatgccggaagtacagatcgatatattccgattggtttgtctgccggtggaaaactagatggagatgcctctaaatcaaagtcaaattattatacgataattaatgagaatattttgacttatgataagaagttcaataagaaccatgcactgaacctgatggggggtgttactttccaaacctatcaatataatagtctaagcgggtcaggtacaggctttttgcgtgatgtttatgaaaccaataatttgggagttgcttcaacacccggaactccttcttcgggttttagtgattaccggatggtttctttcttgggacgtgccaattataatctgctggaaagatatttgttgacagtaacagcacgttatgatggttcgtctaaattcagtaaaaatcataaattcgcctttttcccctctgctgctttagcctggcgtgtgtcggaagaagattttatgaaagatatcgactggatgagtaacctgaaattgcgtgctagtatcggacagactgggaatcaatctatcagtccttatcagacttttgcccgcctgggaacatccgggcctattttcggtaatggtaaagatatcggttttaatttatcttctatggctaatgatgatttgaaatgggagacaaccacacaaaccgacattggcattgattttggatttttctcaaaccgtttgaatattggttttgattattactggaaacaaacacgtgacttgttgtataatgcaacacttcctccttcttccggctattcttccatgttgaggaatttaggacgtatcgataataaaggttttgaaatctctatcaatacaataaatatgagaggaaaagtgaactggactacaaacttgaacataacatctaacaaatcagtagtgaaagatttgggtacagatgtatatggaaataaaattatgcgaatcgatgctcctatcggtggaggaaactggttccctttgtttgtcggaaaagcgccgttccagttatatggatatgagattgaaggtatttatcaaacggatgaagaggcccgttcgaatggtgaagctactaaaaaagccggtgattaccgatataaagatacggatggaaaagcaggtattactactggtgataagaccattatcgctaacacgcagcctaaatttactttcggtctaacaaatacgatcaattggaataattttgaattttctttcctggtgatcggtagtataggtggagatatagtaaacgaatttaataagagcattaccaatatcggtggaacatggaatattcgtaaagatgtatggcaaaatcattggacgccggagaatccgaatgctaagtacgcacgtgcttctgcttcaacgaaagattatctggcatttggtgatccgagttctatttgggtggaaaatggttcatacctgcgttttaaggatattaagttggcgtatacattacctactcagtggtttgcaggtgcacgtaaacccaatatatcggtttatctgagtggacagaacctgatcacgatcacaagttactcgcattatgatccggaagcatcctggacatcttccgcagtgaacggatgggatagaggtgtttatccgtctgcaaaatcatttactttgggtttacaggttaaattttaatacttattataagaatgaaaacactgattaaaaatatattactggcagtaccggttgttctatctacttcttgctcgagttggctggaagaggatccgaagacatttatttctccttcttctttttatcagacagtggaagattttgatggagctttgaaagggttatatcctcaggatcaaaacctgaatctgacagaagtttttgccgattataatgataaacctgaatcagcagagcaggtcggtgatatttgggcaaataatccgggctatggtttttatgcattccgaggtgcctggtctggatcttacagtactattaaaaataccaatatgatattggcggaaatagaaaataaggatttttcggcagaaacaaaaaatcgtattattggtgaagcgagatgtttgcgtgcttggtcttactttacgttggttcagttttttggcgatgtgcctttgcgggataaagtcgtttctagtgatgcggaagttgcgatagatcgtaccccccaggtggatatttataaatttattattgaagatattctggatgcggagcagaaattgccggaggaagcattagaaatgggacgtgtagataagtatgttgcaaaagcaattatggcacgtatttatttaacatcggctggttatccgatgaatcagaaagaaaattttgcgaaagcaaaagaaaaagcgctggaagtaattaatagtggcaagtattctttaatgccaacctttgataaggttttcaaaacagaacgttatacggctgaaactatttgggcacagttgttttctgcgcctgatagttatagcggtatgcataataattcttcacctatcggtagccagactgctttatatttgccgacgaatgcttttatctccagttttgccaaaggggatatgcgtaaagaatgggggattaagccggagtatataaacgctaaagggaataaagtgattagtcgtacatattataataagtatattaatgaagaatatttggaacaggagcttcctgcttcaaacactaatattctgacctggcaaacccaattgatccgtttggcagaaatgtatctgattgctgcagaagctgaaaatgaggtgaacggaccggccggagcttatcaatatattaatgctgttcgtaaacgtgcccgcgtagatcagagtgatcctacgaatgtcccggatttgagcggactaacccaggatcagttccgggaagcggttctgttggagcgtaagcatgaattgtatgaagagggttttgcttggtatgatctgaaacgcacccagacatttgacaaagtgcagaaagcacgtggtgacagattgaatgtacctatcggaacttacaacaatacctggttgataccggataccgaaattctgaataataatattcctcagaatccggattacagataattaatgtagaatacatgaagggccggtctgagatattttcgggttggcccttcttatatccatatatcaagaatgaaaaagcagtttgtttattttttatttttatgtgcagcttgtttactggcatgcagcaatccggttgatccgacagctttagaattaaagccttcggagattaatcgcctgatcccttttcggggagaattgaataatggtgtacgtcaactttatccagaggagccttataaagctttttgggctgagaactggagtacacctgaacagtcgatcgtgtggaaagttaatactgacggtgaagattatcaggcagccatgttggtttccgtcaatcatcttggagaaggagaggaaactgtattgatgctttctaatggaacagacagtgtcgtttgtcggataggaacaaccggatggcaacgttgtagcttcccacggcctttacattttaataaaggaacatctgaattgtctgtaaaaatcagtgagccgggtaaaatggatgattttaatgttaatctctattcgttggaagttgctaggcctgaaacttatgaaagattacaggtggaagcaacattattgcgtagcgatgcatcctggatggcagatctgccttatggattcttcttccattggaattcgaaaagtatgcctcagtcaggagaaccgctaatgtacgaggatgcagtcaatcagttcgatgtggaccgctttgctaaaaccgtttatgagtgtggtggaaaactgatcttttttacaacctcatgggcagaatactatttccctgctccgatacaatccatagattccattttgccaggaagaactacgaagcgggatttagtagcagagttgtccgatgcattaggtaagtatggtattcgtctaatcctatattatcatgtcggtcatggcgataaagaatggtgggataagcaacactatacacgtaataatgccggtgatctgtttacaaatgtggaaaagatcgtcagtgagatcagtcagcgttatggcaatcgtctggcaggtttgtggatggatgacggtatcggttattatccgaatggcgcatcttttgaaaagattgctaaagccgccaaaagcggaaataaagatttagtaatttgttttaatccctggatattaccgaagttgacagagtttcaggattattatgccggggagttagggttgtctttagccagtgccggggtaaatgatccttatcttcctgaagatggagacggtctgtttcatggcggacctcaggatggtttgcaagctactttttccggtacattggaaccgggtgattggactcatatttataaagactctattatcggtgatcctgttctttctatcgacgagttgacacaggttgtgagagagtctaataagcggaagaatcttccgatgattaatgtacgtatttatcaggacggcacgatctctccgaaatcgtacgccttattgaaagaactgaataaacgtatcggtaaagattaagtagtattttttgttctattgttccacttggatgaaattttattagcgagagtgtcataaatatttgacctctcgttaatgcttataatattttagagagtaagtagcttctttttacaagaatgcatttcaagtagttttttgtgaagatattgtattagtttaatcatagttttgtttataaatttgaaattagctatattagcaatttcaaagtataaacatgaaaaatatactattattcatattgttattcacttctgtttttttttcttgtcaagaagatcgaaatactcgtaacctgcttgaccgggtagaaaagcttgtcgaaaccaatgtagatagtgcccgtatcctgctggacagcatccaaatgcctgagactatgaatgacaaactctttgcacgatggtgcatgcttgaagggaaaatggcagacaagcagcatgaagatatgccttatgtagaacaactaactcgagcctctaattggtatgcaaaacacggaacaaaggagcaacaagcttggattggcctttacttaggtcgttcctatgctgaagacaaactttttgttcctgctacaaatgcttattcagatgcattggaaatagcattgaagggaaatgcatataatgtggcgggatatatttgtagttatatgggagatttatatctctatacaggacaaactgttgaagaactgcggaaatatgaagaggctgccgattattttaaaaaggcaggaaatacgagaagttatgcgtttgcattgaggaacattgccaaagcttggtcttttgaagattcttgtaatgtagcactggactatatgctaaaggctgattctattataaaagggatgaatgactctgccggtatggcttcaattacaaatggcttgggaaatatctattacttgagaaaagatttcgcaaaagctaaaaattatttttttaaatcaataatgtatgatactgtaaattcttcaccaagcttttctgcattatcaaatatgtatttagatgatggattgttggattcagctcgatattatttaatgcaagcttacaggcctactcgtaatccatataccttagtagctcttttatacgaaaattatcagatagaaaaagaagtcggtaatatttcggaggcattggaatatatggaacagtataataatgcaaaggattcgttgtataacgaagaaatgcaggttgatattattgatgcagagaaacgtcataatttgtcagagttattaaagaataataaagacctttatattgccaaatatttttatgttgtgctattttcattatcagttgtttcatgtttaagtgtttatttgatttatctaatacgagataaaaataagatgaaaaaaataaatgatcagcaagttttgttagagcaaaaggaagtgcgactaaaagaattggagaaagaaatacatttgaaaaattccaaactagaagatactaggaatcttcaacaagagtttgaaaaaacaagacaagattttaatactttaaagattgcaaaatttaatgctagtatgattgttaagaggataaagaaactatgtgaaaaagtaaatcctgataaagaacagacactcacttctaaagattggaatagcttaattgctcttgtaaatactttttatccaaatgttgcaactttcatcgacagtaatttgtgtaatctgacagaaaaagaaacagaaatgtgctatcttagttttcttcagttggatgtgaaagaagagtctatacttttagatataaatcctgaatctgtaagcaaacgtaggcttagaacccgccaaaaacttaatttgactaatcttgagaaaagtatttttgaattccttgtaacctgttgattttctttagtaatactaattgattgtcttggtaataataatgcttgtccatatgctgtgtttgtaatactttggtagttaatgtgttaatattgtttgaagttacgggcttgtccatgtgtatttcattggttttctttattcatattctaaatacctctacttttgctgtgaaattttaacaaattagatatgagaaggaataaagtgttaaatgttgtactagtgttattttgtatattacaaggaattaagaatgttgtggacgatagatatgtaactttagctacacctgataactctcgctctgactataagattgcatatttgaatccaatatcatcaaacacaaaaagtgagcagatacattttgatctattgacttacacaaagagcgataatacaaagcgtgcatatgcagattgttttttaattaagaatacggcttttgacgatagtcacggtgcaaatcaaacaatggtacaatttcaaataagtgttgatggaaagaaaaagagacctacaggatggaaacattattcaactggatattctgtatcacaaatagagtgtatatttaatgaaataccagtagaagtgtatcctaatggttatattaaaactcttgcaacaaagaagctgagtgtaccaagtacggttgatttaggagaagggaaatctggaacttatacagttaatttgatgaacttttctgttcgtaatatgtcagatccattacaattaccagattgtatacattttaaagctgaaacacgagggacaagtccggaaggggttggttataattattataaaggctcatatttagatcctgcggtatgtcttgaaaagaatggagcttctgatatttgtcccaatcataaaaatgtttacagcaggtagtaataatttttatattacattattgaatacaaaaacagtctagaggtggaggagaatagaagttcttaaatatttatagacagataaaacttacctaagattacaatatttgtgtaatcttaggtaagatttcttttatataaaaataaatttatgaaaacgatgaaattattaattgtagttttattttgcttcggttttatgcaagtggaagcacaattgcgtttgggggcagaagttgggattgatttatcgagtgtaaatgttgtgactaaccatactcagatcggatcgaatggaggcgtatcggttgactacacgtttaaaaataagatcaatctggcgacaggaatatatcatacaatgaaaggtgccaatacggtttgtgcagattcatatggttatgaaatgctcgtcagactgggatatgttgaattacctttgatgatcggttatcgtattccggttgcatcgaatatctatttgactcctactataggaggatatttagcttggggtgttaatgggtatggagagtttgagaaaaatcgggttttcgatgatcccaatgagtttatgaatataacagaatggtcgaacccgtttaaaaatcattattataagacagcatctggatcagggatagtaaatgctttcaatcgttttgatgggggacttcgttttggattgaatgcagacatagggaaagtgaacttgtcttttaattatgatttggggctaaaagaaatgtggccgggatttttagatgggaaattagtacatcctttaagaaaccggaatgcaactttagctatcgggtataagtttatcttataatattactggagaattggtctaaattgggatggttatctgttaaaatgcaagatgaccaccctcttttattgataaatgaaagaaaaagtaagatttttcttttaaatcctttgctcatataaattattgttctacatttgcagcgtcaaacaaattaaagacgataagaaaagatgatgaacaatgtattacatattattctcgtggtggtccttctagtcattagtaggtaaggagaaaggtgtgtaagaagttgtgaagtcgtaaatgatatttcttaagcctttctccatatagagaagggcttttttattgactaaaagataaaaacaaatatgatgaagaatccgttaagaagttcatatagcacagagggtagacgcatggccggcgcccgtgctttgtggcgtgccaacggcatgaaagaagagcagttcggtaaaccgattatagccattgtgaattcatttacccagtttgtcccgggacatgtgcatctgcacgagatcggacagcaggtgaaagcggagattgaaaagctcggttgctttgccgcagaattcaatacgatcgctatcgacgacggtattgccatgggacacgacggaatgctttattcccttccttcccgcgacattattgcagatagcgtcgaatatatggtgaatgcgcataaggcagatgctatggtatgtatcagcaactgcgacaagatcactccgggtatgctgatggccagtatgcgcctgaacattccaaccatatttgtatcaggaggcccaatggaagccggtaacctggatggtcgtgcactcgacctgatcgatgctatgatcgaagctgccgatgattcagtgagcgatgaacaggtagagaaggttgaacgttcggcttgtccgacctgcggatgttgttccggtatgtttactgctaattcgatgaattgtctgaatgaagcgatcggtctggctcttcccggtaacggtacagtggtggctactcatgccaaccgtacccgcctgtttaaaaaggctgccaaaatgatcgtggataatgcgtttaaatattatcgtgacggggatgattctgtattaccccgtagcattgccacccgccaagcattcctgaatgcgatgtcactcgatattgcaatgggaggatctaccaatacagtccttcacttactggcaatagcccatgaagcggaagccgatttcaccatgaaagatatcgatatgctttcccgtaaaaccccggttatctgtaaagtggctccgagctgttcctatcatgtggaagatgtgaaccgtgcaggaggtattatgggtatcatgaatgaattggtaaaagccggtctggtggatgattcggtgaagcgtgtggacggactgaccttgggacaggcgatcgaccaatattgtatcacatccgtaaacgtaacggaagaagctgtcaatatttataaaagtgctccggcacaccgtttcaatctggtgctcggatcacaggaaagctattataaggaattggatacagaccgtactgccggttgcatccgtgatgtggaacatgcttatgtaaaagatggtggtctggctgttctttacggaaatatagcgcaggatggttgtgttgtcaaaacggcaggggtagatgaaagtatcttccgttttgcaggtccggcaaaagttttcgattcgcaggatgctgcttgcgagggtatccttaaagacaaagtcgtctccggcgatgtcgtcgttatcacctatgaaggtccgaagggtggtccgggtatgcaggaaatgttgtatcctacctcttatataaagagtaaacacctgggtaaggaatgtgcattgatcacagacggacgcttcagcggtggaacatcaggtttgtcaatcggacatatttctcccgaagcagcagcaggtggagcgattggcttagtgaaagacggcgatattattgaaattaatatacctgagagaaccataaacgtaaaggttagcgatgaagaactcgccaagcgccgtcaggcagaagaagcccgcggaccgaaagcctttactcctcctttccgccagcgtacggtatcgaaagcactgaaggcatacgcaaagatggttgcttcggccgataaaggcggtgtacgaattgtagaagattaataaaacaccaaatactataatttagagatggataaacaaaagataaccggttcggaagctttgctgaaagcgctgatcgctgaaggagtagatactatcttcggttatccgggtggacaggcaattcctatatatgatagtttatatgactataaagatcaattgaaacacgttctggtacgccatgaacaaggtgcaacacatgcggctcagggatatgcccgcgtttccggtaaagtgggggtaacgttggttacttccggaccaggagcaacaaataccattaccggtattgccgatgcgttgatggacagtacgccgatggtagtaattgccggacaagttccgtctccactgctgggtaccgacgcttttcaggaagtcgacgtaatcggtattacgcaaccaatcactaaatgggcctatcagatccgtaagccggaagaaatagcctgggccgtatcccgtgctttctatatcgcatcgacgggacgtcccggtccggtagtacttgacctggccaaagatgcacaagtaggtttggtggattatgaatacgaaaaggtaaattatatacgcagttatcagccggagccggatatcaagcaggaacgtattgaagccgctgccgctctgatcaatggttcaaagaaaccattctgtctggtaggccagggggttatcctgggaggggcagaagaggaattgaaagcctttttggagaaaaacgatatacctgccggttcgaccgtattaggattgtcggcacttccttccgactttcccttacataaaggtatgcttggtatgcatggaaatgtaggacctaaccggaagacaaacgaatgtgatgtgttgatcgctatcggtatgcgtttcgacgaccgtgtaaccggcgatttgaagacatacgccaagcaggcaaaaattatccatctggatatcgacaactcggaaatcggaaagaatgtacctgttgatgtaaaggtattgggtaatgccaaacacaccattccgatgatcacctctttattggaagaacggaagcgtcccgaatggaatgccgagtttgagccggatgaaaaggaagaagaagaaaaagtgatccgtaaggaacttttccctaccgaaggtcagttgaagatgggtgaagtagtacgtaaagtatccgaagcaaccggcaatgatgccatcctggttaccgatgtaggtcaaaatcagatgatgggtgtccgttacttcaaatataaacaaacccgtagcgtggtaacttcaggaggtctgggtacgatgggcttcggtcttcccgctgctatcggagccaaactgggtgctcccgaccgtacggtttgtttctttaccggcgacggtggtatccagatgactatccaggaactgggaaccatcatgcaggaagaactgaatgtgaagatcatcgttcttaataataatttcctcggtatggtacgccagtggcaggaattgttcttccaggaacgttattcgaacaccatcatgaaaaatccggactttgtcgcgatagccaaggcattcggtattgcttcccgcgctgttgacagccgtgaagaactggacggtgcaatagaagaaatgcttaaccatgacggcgcttacctgttggttgccaacgtggaaacctgtggaatggtatatccgatggttccggccggaggaagcgttacgaatatgattttaggtgctaagtaaggaggaacaattatgaatacgaaaaatttatataccgttattatcttttcagaaaacacagtaggtcttctgaaccagataaccgttatctttacgcgccggcaactgaatattgagacgctttctgtttctccctctgctataaagggaatacataagtttacaattactacctttgccgacgaagatacgatcgataaggtcgttaagcagatcgacaaacgtgtggatattctgaaagcttattataatacggatgaggacctggtttaccaggaaatagctctttacaaactgagtaccgaactctttatcaagatgggtacggtagaagatctgatccgtaagtataatgcccgtatcctcgaaatgaacgagagctgtgtcgtactcgaaaagagtggtcattatgatgaaacacaagccttgttcaaagaactgagtgagacgatcggtgtgttgcaattcatccgttccggtcgtgttgcgattacgaagagtaaggtagagcgtctgagcgatatgctgtcctcgatggaaaagaagttgcaggataaacattaatacaaatagaaggacttcgtcccttgtaaaaagaagattatggagaagaacaaagtaggagaatttcatttcgtaaccgagtcctatctaatggactttcggggccgcatcactattccgatgatcggaacttatttgctgcacgccgcttcctgtcatgccgccgaccgtggattcggttataacgacatgaccgaaaggcataccgcatgggtgctttcccgtctggcaatcgaaatgacttcctatccggctatgtccgagtccgtaaccttatatacctgggtcgatgaagtcggaaagttatttaccagccgttgtttcgaattggtgaatggagaaggtaaaacattcggctttgcccgttccatctgggcggctatcgatgtggaaacccgtcgtccgaccttgctcgatgtagaagggctgagtgcctatgtcaccgaccgtccctgtccgatcgagaaacccggtaagatcgccccggtagaaaacaacatacccggtgagtcctatcgtgtgaaatacagtgacctcgatgtgaacggtcatctgaacagtatcaaatatatggagcatctgctcgacctgttcgatatcggcatgttccgtgaaaaagagataagccgtttcgaaatagcttatcagtctgaaggtaaatacggtatggagttgacccttcatcatcaggaagtatccgcagacaaatataatatggcaatatgtaatgacggcaaagcgatcagccgtgccgccgttacttggaaataaccatatagaaagagacaaattattttatatacattttaatagtaaaaagaaaatggcagtaatgaattttggcggcgttgacgaaaatgtagtaacccgcgaagaatttccgttggaaaaggcaagagaagtattgaaagacgaaactatcgctgtgataggttacggcgtacaaggtccgggtcagagcctgaacttgcgcgacaacggttttaacgtaattgtaggacaacgtaaaggtggtaagacttgggaaaaagccgttgcagacggttgggtaccgggcgaaacactgttcgatatcgaagaagcttgcgaaaaagcgacaatcatacagtatctgctttcagatgccgcacagattgaagtatggccgcgtatcaaaaaatacctgactccgggtaaggctttgtatttctctcacggtttcggtattacttataaagaacgtacaaacatcatccctcctgccgatgtagacgtaatcctggttgctccgaaaggatcgggtacttcacttcgtcgtatgttcctgcagggccgtggtttgaactcaagctacgcaatcttccaggatgcaacaggcaaagcatgggatcgtgtaatcgcactgggtatcggtgtgggttcaggttacttgttcgaaacaactttcaagaaagaagtatattccgacctgaccggcgaacgtggtactttgatgggtgcaatccagggattgctgcttgcgcagtacgaaacactgcgtgaaaatggtcacgaaccttctgaagcattcaatgaaacagtagaagaattgacacagtcgttgatgcctttgttcgcagaaaatggtatggactggatgtatgcaaactgttcaactactgcacagcgcggtgctttggactggatgggcccgttccacgatgccacaaaacctgtattccagaaattgtatagcgaagttgcatgcggtaacgaagcacagcgttctatcgatactaacagcaaacctgactaccgtgaaggtcttgaaaaagaactgaaagcacttcgtgaaagcgaaatgtggcgtgccggtgctgttgttcgtaaacttcgtcccgaaaacaactaatagttggtgcgataaataagtattaaacatcttgcgatataaagcggtaatccggtatgttccgggttgccgctttttctttcccgttaccagttaagcataaacctatgactagctaagtctttcctcatgacttattaataccaaagtccttacttattaaatataccctgtacatcttgtctgattatcctgtacaccctgattattcatcctgtacaccttggatagctaccctgtacagggtaataataagtagcggggacttttgatttagaaactccctggctatgcaataaaaggtgccgggaagggatatagtggttgcctgtgtgacaaattttagctaagtaagttttctatcataaagttttccgaatttatctgtcatctgcaactgttgtttgtatttgtttggctattaggttgtaaacggttgcagatagctgtttttatctgcaactgaatctgtcatctgtcatcggtatggaacatcacggttttatatgttaaagcccgttattggtggagcgggtttattgatctcatatacttattgtatttgataggttaggagtttttatggagttacttttctttacaaagaattgttaaatagtgaggaataaagtattaaatatatatttttatgcttgcggttattaatgatagattatatttgttgaagaaagtacggtgtgtttagtcaagataaatgggttggtgtttgtgggtaaaaagttgtgtgtcttgattttgtgaactttattttagtgcgtatggacctggcgctttttgaggagagaagtgtaacctctaatgaaatgaatactgttatgattaaaattatttaattaaagtcttgaatttaactatgtggacagactcaaaactaattaaatcactaatgttttctgtattgtttggagctgcgggtactgtagttgcagctattccaacaagtcccgaaacgatggtagtacaacagggaaataaggtctcaggccttgtctctgacgatatggggcccatagccggtgcttctgtcgtagtaaaaggaacttctgtcggtacgattaccgataccgacggtcgatttaccctggataatgtccggcggggatcggttattgtaatatcttttgtcggcttggctacgcaggagattacgtggaacgggcaagccaacttaaatgtcaagatgagtgatgcgacacaggatttggatgaagttgtggttgttgcttatggtacagctaagaaatcgacctttaccgggtcggcctctgttgtgaaagcagagaaactggaaaaggtaatgggtaccggttttactgaagcattacaaggtatgtcggccggtgtgaatgttgtaaacgtacaaggtaaccccggtgctgaagctcgtgtcgaaattcgtggtattgcttctatgtccggaaaggctgatcctttgtatattgtggatggtatgccttacgatggtggtcttaaccagatcaatccgacggatatcgaatcgatgacggtgttgaaggatgctgcggcaacctctttgtatggttcgcgtgctgcgaatggtgttgtgatgattactaccaagagggggaaatcagctaaacctcagattaatttccgcggggcgtggggtacttccgacaatgcggtaaagaaccctaaaaaggctaatccttatcaacagttggaaaatacctggtatgcattgtattacgatgcattgctttacgacggcatggatgccaaggctgccggcgattatgcatcttcccaggcattgaccaagcaggtaaaagcaacgagaaattcaaagggtgaaactatttatgtgaccccgtttagatacatcaacgaagattatgttttgcatgacggtaacggaaatccttacatgaatcctaatctggaatatgtatgggatgaagacgactgggatgtttataaggccatcttctcccgaaaactacgtcaggattatagtgtggatataagtgggcaaaccggaaatggtaagacttcatatttcttctccggtggttacctggatgatcaggggtatggaaatcgccagtattacaaacggtattctttccgtacgaatttaagtacggaactgttcgactggtggaaagttgcaggtagcttgtcatattcccgtcatcgccaaaatgtatcgggaggtgccagccgtgctgcaaactttacgacaacactgtcgtctccctggttgcgtaacgaggataatacaggatgggtggtttcggaaaagaccggaaaaagaatgtacgactatggtaaatataccaacaacttctttggagcgcatgtcctgaacaattcgggtgactattgggataatgggaatgatgatagttttgataataatatggggcatattctttcggctcagtttaacacagagtttaaattgccgtataacctaaagttccgttctgctttgaatatcgacgattattggagtcgttcaatggtgtatacatctgctgtgcatggtagtggtcagactgctccttatggaatttctatcctggcggatggaggttatgccagccgttatgatttcaataagcgctctactacctggaataatgtgttgtcgggcgactggtcgatcggtgatcataatatctccgctatggctggtcacgagtggtatacctgggattcccactatgagcaaggttggggtgaaggaatcatggaattaggtaaatacgagttatcgaatacaaccaaaaattttggtgtatggggaggccgtgataagtattctttgttatcattctttggaaagttggattataatttcctgaataagtattatctctctgcctctattcgtgaggatggttcttcccgcttcagttccgataaccgttggggtacattctggtcgaccggtgcttcctggagaatatcgaaagagggtttcctggaagatgcaaaatggattgacaatctggtacttcgcgccagttatggtacgaccggtaacgataaattgatcgtacgtaacgctagtaacggtaaagcaggtgatgaagtattatatggttatcagggaacttacgaaagtgacgacctttacctgaaatcaggtttgaagccttccacaactccgactccggatctgaaatgggagagcaataagcaatggaacgtaggtttggacttttctttcctcagtcgtctgagcggtacggtggaatattattcccgtacatcccatgacctgttgtattataaagaattgcctctgtcggcccaggtaggtgcagcttccggatataatatgaatatcggtgaccttcgtaatagtggtgttgaaataactgtcaatgccaacatctttacttcaaaagatttcagatgggatatcgatgctaatatgagtaccttaaagaatgaggttacttatctgccgactggtgcttatacctatgccggtacggcttgtacctataaaatggaagaaggtaagtctatctacgaatttatcgctcctcaatatgacggtgtgaatcctgaaacaggtttgccgggttggttgatccgtgatggtaatggcggttgggtacgtacggaagatcaggcgaaagtaactactgatgattttgtatattgtggttccgctattcctaaagtatttggttctatcaccaacaacttccagtttaaagggatcgacctgtcgtttatgttctattattcttatggatcaaagatttctgactatacctataaagaacgtattatgaaccgtccgggtgtaggtgtcgtacaagaattggtggaagaccgctggaggcagccgggtgatgcgggaacacttatcccccgttggtcgtatactcaatatggcgcaacagttaaatatgccgataattttgtgtttgacaaccattactggcgtctgagaaacctgactttaggttatactttgccaaagaatatcagccgtaaggcattggtggaaaacctgcgtgtgtatgtgacaggtaataacctgttgactttcggaccggcaaagaagcgctttacagatcccgaaacaggtgtaatgggtaacagttataatggtaacgctgaaacggataacggtattcagggttcaagaagactgtatatggtcggtattcaaatcacattataaatgcaaaaaagatatttatgaaaagattatttataaacatatccttcctgtccctcgtttttgtaggttttaccctgacaggatgtgatgacgatctgacaaccagttcgtatgtgaaagtgaatgatacggatgtgctcgagaatatatcccagctggaaaaagtattgacctcggcttataaacagttgtattttaatacggataaaggcgatcgtgtatatgccgggcttccgggtttccaaatgtatgtcgatgcaggaggtgcggatatcgtgagccatactaatatgggtggcgaccaggtaacggcttatcaatattcgaactcaaagactcaggcggatgggaatgcatccaagatatggtcgatgtgctataacgtgatcaaccgtgctaacattatcctgaccaatgtagataatgccagcggtgatgaaacgcaaaagaagcatattaaagggcaggcactggctatgcgtggaatccaatacttccatttgattcagaattaccagcagacgtatgttattgcaaaaaacaaacggggtgtgattttgcgtacatcttccactgatgaggctcataaaggcttttcaactgtggaggaaatatatactcagatcgtatctgaccttaccactgcaaagtcgttgcttgctgattatcatccgacagacttatggttaattaattcggagatctgttccggtattctggctcgtgtatatctggtgatgcagaactgggaaggggcttacaatgaagcgaagatcgtttatgacaaccatagtcagttgatgacgcgtgaacagtatcgttcgggattcgacgatatgatcagcggcaattatccggaagtggtttgggcgatgaagtatacagccgataacaacctgggaggtagtacgcagtttaacttctggtacaatcaggacgaaagttatggtgaaggttatgcggatggaccgatctattctttcctggattactttgtggatgagcagtttgtgaaattatttgaagaaaaggaagaccgctatcagttctggaaacgaacaaagaatgcaaacaaagaaatcaatacaaaatgggcgttcgataagtataaacattatggagaagatggaggaagtgtgatccagagtgctacccgtcctgaagtgtgcttgatgcgtggtgctgaaatgttgctgattatggcggaggctgctgcacagaaaggtagtacaggagaggctcttactttattgaatcgtttgcaggttgcacgtaatgcgactccgactaccaatagtggtggggattcattattagaagatatctacaaagaacgtcgtaaagaactgatttgtgaaggacaggcaggtttttatgatctggttcgtttgcagaagcgattggtgcgttatggtgaaacgacagcaaatcctgccgggcattatgtatggggtatgcaatacttgaatggatataatgtcagtgatcttcaacctgtggggattcttgaatcgaatgattaccgtttcttctgtcagattcctcaaatggaaatccttaataacgatgcaatctcagaggctgatcagaatccctggagcgggcagtaaaaactagattactattaatagtaagaaggagcttttaggggctccttttttatgtcttgaataccatagtttctatagaactcatatattccaggagacaaatatagtaatattatttaatttgagtttaattataccgttaaaatgttattggttaagaattttaacataagtaatcccaaagagatgcaaggtgtgtattatataaaaacaaccttaagttgtttattgccattggtatatcgatattagtagagataaaataagtattcttgtatatttatgcatgcttcaagaatttaacaaaacctactttattctaaaaaacaagacaatagttctatagagactatggcatttaatttaagtatttaaatgcttttctggagatcaggtatttcctcgatagtattaaagttcagaaagtcagtctcttattttaaatcaaatcagagtatttgtgaacgctatcgcgtagttaaaataggtttaatcgtttaattgtaattttagcttatgttgacaaactcgagactggttaaggcattacttctggctactgtatttgcttcagccgggactattaatgccgttgtgattccgacctcattaggtgctacgatcacgcagcagaaaaacaaagttacaggtttcgtagaggatgaaatggggccggttgccggtgcctctatctctatcaaaggtacttcctatggtacaattacggatatggatggtaattttgtattggatggtattcaaaaaggaaatgttcttgttgtttcttttgtcggattacagacacaggaggttgtttggaatggacaaagttcaataaaagtaaagctgacaagcgatactcaggatttggatgaggtcgtagttgttgcttatggtacagcaaaaaagtcctcttttacaggttctgcttctgtggtaaagtctgatcaactggaaaaaatttctgctactagctttacggaagccttacaaggtatgagtgccggtgtgaatgtttccaataatgaaggtaacccgggtggtgaaactcgtatccagattcgtggtatcagttctatgtccggtaagacaactccgttatatgtggtggatggtatgccttatgacggtagtataaattctatttcaccttcagacattgagtcaatgactgttttgaaggatgctgccgcttcttcactgtacggttcacgtgcagcaaacggagtcgtggtaattacaactaaaaaaggtaaagtcggtaagccggttataaatttccgtggtgcttggggtacttccgacaatgcggtagcaaatcctaaaaaggcagatccctaccagcaattaactaatttgtggcgtggtatttataatgacaaacactatgtagaaggtctggattcaaagacggccggtgattatgcttctgctaatctattgtcacgtgctgtcaatccgcgtgtaaactcaaagggagaaactgtatatgtcactccgtttaaatggacaggcgatgcttccaattatgtactgcatgatggcgatggtaattgctggactaacccggacctggaaatggtgtgggatgaaagcgattatgactggtatggtgctttgttctcacgaaaattgcgtcaggattacggcattgatgtcagtggtgctacacaagatggcaaaaccaattatttcacatctttatcttatttgaatgataaggggtatgctaataaccagtattataaacgttattcattccgtgccagtgttactaccgagttgacgaattggttgaatatgggtggaagcctggcttatagctattcacgtcagaatatctccggtgcaacccgtgctactgtatatacaaatacattgaattcaccttggttgcgtaacgaagataacactgcttggtatacttccgaaaagacaggaaagcgtatctatgattttggtgaaaatacagcaaacttctttggtatacacagtttggctaattccggtgactattggaataaccctaatgatgacgactttaacaataaagaaggtggcatgctgacagctcactattttgcaggtctgaatctgcctttcgatataaaattcaagacgaatgtaaacctggatgatattacggaaacgcaatatcaatatggttcagctgttcacggacaaggacaacagcagccatacggtgttacagtgcttacaaatggtggttgggcttcccgtactaattacaagactcagtctgtaacctggaataatttgttgacctggaataaatcttttggtgaacataatctggatcttatgttaggtcatgagttttatcactataaccaacagtatgactatagttatggtgaaggtatcatgcagataggtcaatttgaaacggcttcaacaacaactaattgggaaattaactcctggcgcaatcgttattctttgctgtcgttctttggtaaggtggattataatttccagaacaaatattacttgtcggcttctttccgtcgtgacggatcttcccgtttcagcaaagatagtcgctggggtaacttcttctctgtaggtgcatcctggagaatctcgaaagaaaaattcatggaaaatacaagcagttggttggataatctttctcttcgtggtagctatggtacgtcgggtaatgataagttatatcctcgtaatgcaggtaacgggcaggctggagatgaaattctgtatgcttaccaggcttattatacaaaagaaaacctgtttggtgcagctggttacaagccgatgactattgccactccaaacctgaaatgggaacgaaacgaacaatataacattgcagtagacttttctttcctgaatcgtctgagtggaacaatcgaatattattcacgcagttcaaaagatttgttgtattatcgtgacctgccgttgtcagcacaggttggggatgctgccggttacaatacgaacttaggtaatgtccgtaacagtggttttgaaattactttaagcgctgccgctattaagaataaggagttccagtggaatattgacttaaacttctctactttggacaatgaagtaacttatttgcctggtggtgcttatacttatgcaaatcgtggtgcaacctataaactggaagaaggacattcattgtatgaattttacatgccgaaacatgccggcgtaaatccggacaatggtaatcgtctttatctgatcaaggatggtaatggcggatggaaaacaactgaaaactattcggatgtgaccatgaatgattaccaatggtgcggatcagctattccgactgctttcggatctattaccaatacatttaattataaaggatttgacttgtcattcatgttctatgcttcgtttggagctactatgtacgattatacctggttggaacgtacagcaggtttggatggcgtaggcatgattcaggacctggtggaaggaaaacgttgggaaaaaccgggtgatcaggctgagttctcccgtttgtcttccgctaatgccagcttgaatgtgaaacgtacggatttcttcttgttcaacaacgactttctgcgtttgagaaacgttacattgggctatacgattccgaaaatgttgactcagaaactgggtattgccaatgctcgtgtttatctgacaggtgataacctgtgtacattcggaccggctgctaaacgtcacagcgaaccggaaaccggtgtgttaggtaataactacaatggtaataccgaaaccgataatggtgttcagggatcaagaagagtttatatggcaggtattcaggtaacattttaattaagtcgaagtatgaaaagattatatagaacatttaaatttacagcaattgctttattggcgatctctctgagcaattgtacgggggaattgactaccaattcatcaacggatgtagatgaatcaaccatcctctccagtacgacgggattgaatatgtcgttgaccggtacttataaatatttattattaggtgagtccggtgccagcagtcagaacgatgcttgttatgctggtgttaccgggctgtgcatgggatatgatttgctgggtgcagatatcctgagtacaaagaattacggtggttcggtagaggatcactatcgttttagcgaaggtcgtacgcaatctgctggtgactatgcaaaacgaatctggacaaatatgtataaaattatcaaccaggtaaatgtcattattgatgcacttcccgaagcgacaggtagtgaagctgagaaagctgaattgaaaggacagtgcctggccatgcgtggtatcgcttatttcaatctacttttgaattatcagcagacttatgctattgctaaagataaacgtggtgttattcttcgtttgtcttccgatgatcctgattccatgcctttttctactgtagaacaaggttatcagcaggtgatcaaggatcttaaagatgcagaatctctgctggcttcttttgaacgtagcgaagaatggcgtgtgaatgctgaagttgctgccggttatctggctcgtgtatatcaggtgatgggtgactggaataatgcactgacggaagcaaagaagttgtatgacaatcattcttcattgatgactaaaacggaatggtgtagtgggtttgataatctaatatcagacggatgtaaggaagttatctggggaattaagtttacaaacttgtctaatattagttccaatacagagtttaactattggtataatcaggatccgggttatggtgaaggtatgactgatggtccgatttatagcttcatcaacttatttgttgattccaggtatgtacaattgtttgacgaaactgatttccgtggcagtaaatgtacaaaaacagaaggtgtgacagatgctgatgtgaaacccgttatgttctggcatcgtacagctaatggtaatgaggaaacaagggctaaatgggcatataacaaattcaaatattatggtgatgccaatggttctcctcagggacatacctatcctgaattttgctacatgcgtagtgctgaaatgttattgatcatggcggaagctgaagctaacctgaacaacctgggagcagctttgtctcatctgaatacgttgcaaaacgctcgtgaagtggctaaaccgaccacggcagttgataaagatgtacttttggaagctatttatgtagaacgccgtaaggaattattaggagaaggtgtaacaggtatgtatgatttgatgcgtttgcagaaaccgctttatcgttatgctgcaaccacggaagatccggcaggtcatttctctttgggcttgaatttcctggataactataatccgaccgataaagctccttacggttatttgccgtctaatgactaccgcttcctgtatcagattccacaattggaattcacacagaatactgttatcagtgaatctgaacagaatccgtttaaaggaaattaatttgtaaattatagtaagtaaagacgagaggcgtgtccgcgatggatatgcctctttttttatactacttattttcttgtaaaggagcgatgaactgaatatctttgtaaaattcaaatcattaataacttaaaataataccatgaataagatcaatcttttctttttctttttgttattggctattcttcctgccttttcacaggatgacatccaaatcacccatgccccttatctgcaaaatctgggtgagaatgaagtgacaatcgtctggacggtcaataaaccatcggtaggttgggtggagctggcaccggatgacgggacacatttttatcagacggaacgtccgaagttcttcaatgcaaagaacggaataaagcagacatctaccgttcatgcagttcatctgaaaggattgaaggggggtacacgttatcggtatcgggtatattcacaggaggtcctgagtcatgtcggttggcgagtgatatatgggaatgtggctgccacctctgtttacgggaaacaaccattagagtttcagaccagcgatcatggcaggcaagcggttaactttgcgatggttaatgatattcatggcaagagtgatcttttggaaaagcttgtatcacattgtgacctgaaaacaaccgatatgttcctgttcaatggagatatggtatctatcttcaatagtgaaaaagaaatattcgaaggctttatggataaggcaacagaactttttgcttctgaaataccgatgtattatacccgtggtaatcatgaaacacgcggatctttcgcaacggctttccaggactatttttctcccaaacaggaacatatctattatatgtttcgccagggacctgtctgtttcgttattttggatagcggtgaagataagccggattcagacctggagtatgccggaataactgtctatgaccaatatcgtacggagcaggctgaatggttgaaaggcgtacttgaaagcaaagaatataaggaagcaccattcaaagtggttgtttgtcatattcctccttttggcggatggcatggcaatgaggaagtggctgaaaagtttatgccattactgaataatgcaggtgtcgatattatgctttgtgctcatcttcaccgttatatacggaatgatgcgaaagaggacgttcggtttcccattattgtaaattccaataataccgtattgaaggcggaagttgattccagggtgttgaacataaaaatactggatacggaagggaaggagatcgataagctgaggataaccaaataacggtacattttatcattcttgaactaatgaattatagattcaattgtatttcctctttcagattataagaaaaagcgtataaaaaatatcgttttatatttggcggtttaaaaaaaggctgtatctttgcagcgttaaataagaaaagacaatgaaacagaacatagcaaatagtctcattatttctctaaacattattctactctgggaacgggataggaagtgagactgtacgtgcttttctgatgcatgaagatattaaagagcctttctcacttccttgtgagaagggctttttttatggatacaaacaagaatataaacaaatttaagagtataagattatgtcagacagattatttatttttgacaccacgttgagagatggtgagcaagttccgggatgccagttaaacagtattgaaaagattcaggtggcaagagcgcttgaagaacttggcgtagatgtgattgaagcaggatttccggtatcgagcccgggggacttcaatagtgttgtcgagatatcgaaagctgtcacctggccgaccatctgtgcgttgactcgtgccgtcgaaaaagatatcgacgtggctgccgaagctttgaagtacgctaaacgcggacgtatccacaccggtatcggtacttccgattatcatatccgttataaattcaattccaaccaggatgaaattctggaacgtgctatcgcagctacgaaatatgctaaacgatatgtggaagatattgaattttattgcgaagatgccggacgtacggacaatgcttatctggcccgtgtcgtcgaggccgtgatcaaagccggtgccacagttgtaaatatccctgatacgaccggttattgtctgcctgacgaatatggtgcaaagatcaaatatctgatggaacacgtagacggtatacagaatgcaatcatttctacccactgccataatgacttgggaatggctaccgctaataccgtacagggtgttttgaatggtgcacgccaggtggaagtaaccatcaacggtatcggcgaacgtgccggaaatacctccctggaagaagttgccatgatcttccgcagccataaagaacgtgctatcgaaacaaatatcaatacaactaagatctatggtattagtcgtatggtttcaagcctgatgaatatgcctatccagccgaataaagccattgtcggacgtaatgcgtttgctcactcttccggtatccaccaggatggcgtattgaagaaccgcgaaagctatgagatcatcgacccgaaagatgtcggtatcgacgataacgcaatcgtactgacagcccgtagcggacgtgccgccttgaaacatcgtctgagtgtattgggtgtggaactgagccaggaaaagctggataaggtatatgaagagttcctgaaactggccgaccgtaagaaagatatcaacgacgacgacgtactgatgctggccggcaaagaccgtaccgccatgcatcgtattaaactggattacctgcaggttacttccggtgtcggtttacagtcggtagccagtgtctgtctggatattgccggtgagaagtttgaagctgccgcatccggaaacggtcctgtcgatgcagccattaaagccgtcaaatcgatcattcaccgcacgatgactatccaggagtttctcattcaggcgattaataagggtagcgacgatatgggtaaagtacatatgcaggttgaatacgatgggaataactattatgggtttgctgccaacaccgatattatcgcagcttcagtggaagcctttatcgatgcaatcaataagttcgtaaaataacataatacataattagcaatgagcaagacattatttgagaagatttgggagaagcatgtggtggatacccttcccgacggaacaatacaattttatatcgaccgtctgtattgccatgaagtgaccagtccgcaggctttcgccgggttacgtgcccgtggcctgaagcctttccgtccggaacagatcacttgtatgccggatcataatattccgacattgaaccaggagaaaccgatcgaagacccggtatcgaaaaaccaggtagatacgttggagcagaatgctaaagatttcaacctgacttattacggtctgcaacatccgaagaatggtatcatccatgtggtagggccggaaacaggtatgacccagccgggtatgacgatcgtttgtggtgactcccacacatctacccacggtgctatgggcgctatcgctttcggtatcggtaccagcgaagtggaaatgactctggctacccaatgtatcatgcagcgcaagccgaagacgatgcgtatcactatcgacggcaaacgtaaaccgggcgtaacagccaaggactttgccctgtacattataagtaagatgacaacaggcggtgccaccggttatttcgttgagtatgccggcgaagccattcgcaatacaacaatggaagaacgccttactatctgtaacttgtccatcgaaatgggtgctcgtggcggtatgatcgctcccgaccaggtgactttcgactatctgaaagaccgcgaattcgccccccgtgccgaagcctgggaaaagagcctggctgaatggcgcgaactatatagcgatcccgatgcaaaattcgacaaagagattgttttccatgccgaagatatcgacccgatgatcacctacggtaccaatccgggtatgggaatgggcatacgtgaaagcatcccgacaatggagagtgtggacgaagccggccgtatctcttataaaaaatcacttgattatatggggttcactgccggagagccggtattgggcaaaaagatcgattatgtcttcctgggtagttgtacgaacggccgtatcgaagacttccgcgatttcgcttctttggtgaaaggtaagaaaaaagcggatgatgtaattgtatggctcgtacccggaagctggcaggtagaacgccagatccgtgccgagggtatcgacaaaatcttgaatgaggctggtttcgaactgcgtcagccgggttgttctgcttgtctggccatgaacgaagataaggttccggccggtaaatatgccgtatccacctcaaaccgtaacttcgaaggtcgtcagggacccggtgcacgcacgatcctggccggtccgttggttgcagcggctgccgcagtaacaggaaagattaccgatccgagagatttaatgtaataagattacgaactgaaaaatcaaaagaacgaaatgaaagaaaaattcacgatagtaacatccacctgtgtacctcttcctctggagaatgtagacacagaccagatcatcccggcccgtttcctgaaagcgaccacacgcgagggcttcggcgataatcttttccgcgactggcgttatgacaaggcgggcaaccctaatcctgactttgtactgaatcagaagacgtataaaggagagatcctggtagccggaaagaacttcggtagcggttccagccgcgaacatgctgcctgggcgattgccggatatggattccgggctgttgtcagcagtttcttcgccgacatcttcaagaacaattcgatgaacaacgggctcgttccggttgttgtttctcctgagttcctggcagagatattcgcatctgtcgaagccgatccgaaagcgacgctgacgatcgatctcccttcgcagacgataaccaacaatgcaaccggtaaaagcgaatcctttgacatcaacgcatataagaaagactgtctggtaaacggccttgacgatatcgactacctcttggctaacaagtccaaaatagaatcgtacgaagcaaacagaaaataggatggtagaaataatggatacaacccttcgggacggggaacagacatcgggtgtctcctttgcggctcatgaaaagctcagcattgcacaaatgttgttgagcgatttgggagtgaaccgcgtagaggtagcctcggcacgcgtatcggacggagagttcgaagccgtgaaacgtgtggctgcctgggccgaacgtaccggaaatctgcataagctcgaagtattgggttttgtagatggcgacgcctcgctcaactggatcgaatcggccggttgccgcgtggtaaacctactctgtaaaggttcgtataaacacgtaaccgaacaactccgcaaattgcctgaacagcatattgcagatatccgttctgttgtatcgctggctaccgaaaaaggtattgatgtaaatatttatctggaagactggtcgaacgggatcaagaattctcccgactatgtattcctattggttgatgcgttgaaagacctacccatccgccgttttatgctgcctgatacattgggcattctgaatcccggaaatacatacgatttctgtaagcagatggtggatcgttatcctgacctgcattttgatttccatgcccataacgattacgacctggcagtagccaatgtctactcggctgtgcgggcgggaatacacggtatacataccactatcaacggcttgggggaacgggcaggaaatgcaccgctcagcagtgtgatcgctgtaataaaagatcaactgggagaagaaactcctattaaagaagaaaagatcaatgccgcgagccgtctggtagaaacctattccggcattcatattgccccgaaccgcccgattatcggagaacatgtctttacgcaatgcgccggtgtgcatgcggatggcgacagtaaaaacaatctgtattgcaacgacctgatccccgaacgcttcggacgtgtacgcgaatatgcactcggaaaaacatccggtaaagccaatatccgtatgaacctggaatcgctcggaatagacgtcgacgacgaatccatgcgtaagattaccgagcgcattatcgagttgggtgataagaaagaaatggtgacaaccgaagacctgccttatatcatcagtgatgtccttcaccatgatactatgacagatcaacgtatccgtatattaaattattcattatctttggcacagggactgaggcctgtagcaacactgaagatcgagatcaacggtgaggcttatcaggaatcggcttgtggcgacggacagtatgacgcattcgttcgcgcccttcgtaagatctattcggatctggggcgtccattcccgatgttgaccaactattccgtatctattcctcccggcggtcgtaccgacgctttcgtacagacgatcatcagctggaattttgccggagtagactttaaaacccgcggtcttgatgccgaccagacagaagccgccatcaaggcaacgctgaagatgctgaataagatcgaacaataattataggaggtattagttatgaacaaaagattgaccattgcgctcgtagcgcacgataaccgtaaagcagacatggtagaatgggctgtacacaatgcagaattcctttcccatcatcatttggtatgtaccggaaccaccggtggactgattcgcagcgctttcgacgagaaaggcgtaggtgctgaaattacttgtatgcattccggtccgttaggcggagatgccgaaattgcagcaatggtagtacggaaggaagtggatctggcgatctttctgatcgacgacttgaatccgcagcctcacgaagccgacatccagatgttgcttcgccagtgtcgtgttcataacgtgccgatcgcttgtaaccgttacagtgcagacctgatgattacgagcaccctgtgggatgacgacagttatgtccccacggaacccaaatatgtgttatttaaaagagactaaaagaacagttatttatatgaaattaaacatcgcagtccttcccggcgacggtatcggtcccgagattgtagaacaaggcatgaaagccgtaaaagccgtatgtgagaaatatggccatgaattaagttacaaacatgctttagtgggagctgttgccatcgatgaaacaggcaacccgtatccggacgaaacgcacgagctctgtatgcagagtgatgccgtttattttggtgcgatcggttctccgaaatacgataataacccgtctgccaaggtacgtcccgaacagggattgctgggtatgcgtaagaaactggggctttttgccaatatccgcccggtgacaacgtttccttcgttattgcataagtcgccgcttcgtgccgaactgatcgaaggagcagactttatgtgtatccgcgaattgacaggtggtatgtatttcggtcgtccgcaaggtagaagcgaagatggaaatacggcatacgacacctgcgtttatacccgtgaggagatcgaacgtatcgttcgcctggcttaccagtatgcacagaaacgacgcaagaaagtaacagttgtcgataaggcgaatgtattggcgacttcccgcctgtggcgccaggttgcacaggaaatcgaaaaagaatatccggatgtggaaaccgaatatatgtttgtggacaatgctgcgatgcgtctggttcagtggccgaagagttttgatgtgatggtgactgaaaatatgttcggtgatatcctgacggatgaagcgtctgtgattacaggttcactcggaatgttgccttcggcctctatcggtgtacatacttctgtattcgaaccgatccacggctcttacccgcaagctgccggaaagaatatcgcaaacccgctggccactatcctgagtgccgccctgatgttcgaatatgctttcaacctgatggaggaaggtgctttgatccgtgaagccgttgccgcctctatggatgccaatgtcgtaacggaagatatagctgaaaacggtaaagcctataagacaagtgaagtaggggattggattgctgaatatattgcaaagaaataatttagtagtaggatattttttataagggcggtttgtaaaccgccctttttagtttaacccgtttatttcgtcatcttcatcaactcctcgatgactgccgggtcgtatcccatttcgagtgctttttgaaagtcgttggcggcagactccttttcgtattgggccagttttactttacctcttaatacatataaggaagcaccgggtgtgctttcagcaaaaattttgctgatatcggccatggcccgcgcattctttcccatcatgaagtagacatcggcccgtccttcatacaggagccagtcgcgaggcatctggctgatcaggtaattgaaaatcttttcactctcgtcgtagttgccacgcatcttttccaggatggcatgtcccaggcgggcacgtaccgacttttcgttgatctccaatattttgtcgaaatcctgctcggcccagatataattcttcttttgtatgtagatcaatccccggcaatagagagcctcttcgtttgtcggttcttcgatgaggagggcgttgtaatcgctcaatgccttttccgtttcacccatttcggagtataacgaagcacggttttcgaggattgtcgggttattgggacgtccgctgagtgcagctgtataggagagcaaagcatcttccagttttccctgccggcgttgtatacttcccaggttggtcagtaacgcgtagttcatcgggttacccggttctttgcgcatggctgagcgcagactttcttcggcagataccaggtctttcttgtcgaggaaatcgtaactcttttcaatcaactcttcgtaagattgagcgtaactgcttgccgtcaccagtaggaagacaatgaatatcgaaagtagtctcattctgttgtttttatctgttatttggaatggatacaaagctacgtaaatatattgttcggccgccggattaaaaaaactttatacctttgccacattttataagaaactgttttgattttttcgcctgatgatttgagaaggcttttcggggcagattcgtccctctgatgaggaagatagcgggctatctgacgaagaagagaggcggatatggccgaaaagacgctcaaagcataggcgaaaataacaataaaagaataaaaaaaggctgtttgtaaaaaatcaaaacagtttctaagacttttggggactttgattgttataagataaaagtgtttaattaaaaatgatggatttatgatattattagatgtgttggcgtccaatccgagattggaaggttttattaattctctgatagagcagggcagtcatttagggtggacaataattaaagctgtaatcgtatttattgtagggcggtttattatccggatgataaacaaactcgttcgtcgtattctaaccaagcgtgacttcgacccgtcggtgaagacttttgtcggaagtcttgtcaatgtaaccttgatgatactgttgattatttcggtcgtcggtgcgctgggggtacagacaacttcttttgcggcgctgctggcttctgccggtgttgccatcggtatggctttgagcgggaacctgtcgaactttgcaggtggactgatcatattgcttttcaagccttataaggtaggcgattatatcgagtcgcaaggtgtgggaggtacggtaagggaaattcagattttccatacgatcctgctcacggcagacaataaaaatatatttatccctaacggtgcgctgagcagcggtgtcgttaccaacatcggtaatgaaccgacccgccgtgtagagtggactttcggtgtagagtacggtagcgattttaatcatgttaagagtgtgatcgagtctgtactgtcacaagaaacgcgtgtgttgaacgaaccggctcctttcatcgctttaagtgcactggccgacagtagtgtgaatgtcgttgttcgtgtatgggtgaaaagttccgattactggggcgtttattttgataccaataaggctatttatgaaacatttaatgcagaaggtatcggttttccattcccgcaacttaccgtacatcaggcaaaagactaacttgtccttaaaataaatctttttgttcaataatcaccggatttggttcggtgaggatatattcttaaaaaagtagaacaaaaagatttatctttgtctttcagaaaatttattgaagtgtattgatttgtataaaaatatatagaactttattttgttactttagtattaattatttggttataaaaaatgaaaaaggctcgccattcgtggacgagccttttttcttatgagttcaggcggtctaccgttttcactcctttgacggcttttatctttttgaccagcatattcaacgaatgggtatcccttaccagtacggcgaagttcccctggaagataccgtctaccgagtcgatgttcagcgaacggagcgtaacattgttttctttccctatcaccgaggtaatgtttgttacgatcgtgatgtcgtcacgcccgatcacccgcaacgtgacgatgtagccattgtctccttttccactccatttggcccggatgatacgataaccgaaacggctgaacatctcctgtgcattcggacaatccagacggtgtatcttaattccctgtgtagaaacaaatccgaaaacatcatccccatagatcggattacaacatttggccagtttgtattctatacccgtcaggttcttgtcgatcacaagcacatccttgttcgtggatatctcttccacttcggtggtcttgatgtactcttcggcactacgcacttccgagcgttcgttcccttcggtttccttccgtacatattcctggtattcgtcgatcacattgttggcatccagccgttcttccgctatttcaatatagaagtcggtgacggtcttaaacccttttttcttgatgtaacgcatcaggtaaggttcgtccatctcgatcttccggttcttgaaacggcgttgcagcatttccttggcgaagtcgaccgctttggccgtctcttcccgcagtgcctgcttgatctttacacgggctttggaggtgacgacgatattcagccagtcgcgtttcggcgactgcgtaggggaggtgacgatcgaaaccgtatctccgttatgaagtacatatttaataggtacgtttttctcgtttactttggccgatacacatttactacccaacttcgagtggatggcaaaggcaaagtcgagcacagttgcccctttggccagtttgatcagctcgccggtaggagtgaagacatatatctcgtctttgtacaggtccatcttgaaatcctgcatcaggtcgagcggattgttttccttctcttcgagggctgcacggacggtgttgaggaactcgtccagtccgctttcggcttttacccctttgtatttccagtgggcggccagtcccctctcggcaatctcgtccatacggcgggtacggatctgtacttccacccatttgttttgcgggcccattaccgtgatgtggaggctttcgtatccattcgtcttcggaatggatatccagtctttcatacggttcgggtttggctggtacatatcggttatgatcgagtagacctgccagcagtccgaacgctccttctccaaaggagtatccagtacgacacggatagcgaacaagtcataaatcccttcaaactcgatcttttgctttttgagcttgttgttgatggaatggattgacttcgtacgtcctttgatatcgaacttcaggcccattgcctgcaacttctttttgataggagcgataaattcggcaatatagatatcgcgcgaacgtttcgtctcattcagcttttttttgatgaaatcaaactgcttcggatcggtatatttcagcgacaggtcttccagttcgcttttgattttgtacaatcccagacggtgggccaacggagcatacagatacgatgcttcggtagccaaccgcaaacggtcgtcttcctttagctgtttacccaggcgcatcaggcaaagacggtcggcaatcataatcagtatcacccgtacatcttccgcaaaggaaaagagcaggtgatggaaattctctgagttgacagccgtattgcgtgcatacaggtcggatgttttcaatagccggcggatgatcagcgtcacatcttcatcgaatgttttctcgacttcctccagcgtcacgacctttttcagcacagggcgatagagtaggagtgcgatcacggaagtccgtttcaggccgatttccgttgttgcgatcagggcggtatttatattgcggatcagaccgttgatgccgttcttgtctcttccgtaacagtcgagggcgacaacacgctgcatcaattctttcattttccgtatatcctctttctgtaaaaaggaataaaggctacgtaccaattgtctgtatttcgagaagaaatcttttctctcctcctcagtaaagaacggttgtatatccatagttgcgtctctttttttactgcccatttgaggacaggccgtaaaacatactgtaaaagtatcttttttctccgaatatcaactataatctaagggtatttttatacatttgcgagaagcataggcccggagggggtcgaaatggataagaatactaatttaaaaagatatgctatgttaaacgcaaacgatttaaaacagctggcggataaagggatcagcgaacagcagattgaagaacagttagcttgtttcgtaaaaggctttccttaccttgagattgccgcttcggcttcggttgaaaaaggaataatggttgtttcgcaggaagaccaggccacctatatggatgcctgggatgcttacctggctaaaaataaaagaatccttaagttcgttccggcgtcgggtgctgccagccgtatgtttaagaacctctacgaatttctgtctgctgcctatgacgtgccgaccactgactttgaaaagaagttcttcaacgagatcacccgttttgctttctataatgaattgaatgccgcttgtgtgaaaaatgacggaaaagacattccggcactcattgtatcaggcaactacaaagcagtcgtatcgaacctgttggatagcaaggggctgaactacggacagttacctaaaggcttgcttctgttccataagactgccgataaggtacgcacttctatggaagaacatctggccgaaggtgccatgtatgccaagaacaatgccggcgaagtaaatatccatttcactgtttctcccgaacataaagccttgtttgaaaaactggtgaatgaaaagaagcacgagtacgaagaaaaattctccgttgcttatgatatctctttcagtgttcagaaaccgagtaccgacacgatcgctgccgatatggagaacaatcctttccgcgacaagaatgacaaattgttgttccgtcctggaggtcatggtgcattgatcgaaaacctgaacgatatagatgctgatgtcgtattcgtaaagaacatcgacaatgtggttcccgacagtttcaaatgttcgaccgtaatcttcaagaaagtgattgccggtgtactggtaacattgcaggaacgtattttcaattatctcgacctgatcgagacaggcaaatacacccacgaccaggtggaagaaatgatccatttccttcaatacgatctctgtgtgaagaacccggaaatgaaattgctggaagatgccgaactgatcctttatattaaaggtaagttattgcgtcccctgcgcgtctgcggtatggtgaagaatgtaggtgaaccgggtggcggtccgttcctggcggttaacccggacggaactgtttcgttgcagatactggaaagttcgcagatcgacttgaaagatccggctaagaaagccatgtttgaacaaggtacccatttcaacccggtggacctggtatgtgccctgaagaaccataaaggtgaaaaatataatttaccggaatatgtagataaaaataccggctttatctcttacaagagcaaggatggccgcgatctgaaagcattggaattgcccggcctgtggaatggcgctatgagcgactggaacacagtctttgtagaagttcctatcgaaacattcaacccggtaaagacagtgaacgacttattacgtcccgaacatcaatgattgggtcgatgccataataagaataaggtttaatagaagaaaggcggactcgtgagagcccgccttttattcttatattttcggaagttcccacggagcgcggtattccttacaaaggtatttgtctgcttcggcatcatggaaactggtgccatcccacgatagtttctttccggtgcgataggcgatatttcccagttgcgagaacttggcgatatgggcaccgatctcaatacttgcattacagttgcggttgcgcgacttgatacattccagatggtttttgacatgcaggttcagaccaccttctccatatgctttcttcagggctacggcttccattcgggctttaccgtttactttttcgggaatcacttcccagccgccacggtcgattactaatgtgccgttttcacccacgaagccgagtccgtggttacgtccgtaagcgccgtcgtctattccgatggcatgatcccacatgacggtgaagtcgtcgaaagtataaatcgtttggagcaggtcgggtgtttcgcaggcatcgtccggataaccgaacttaccgcccgatgccatgatggaattcggagccgtcacattcattccgtaaagtgcatagtctaataggtgaacgccccagtctgtcatcagtcctccggcataatcccagaaccagcggaatgtaaaatggaagcggttgcggttgaacggacgctgaggagccgggccgagccacatatcgtaatcgacacctgccggaacgggttcgtcggcaacgaccggaatcgacgggcaccatccctgataagagaatacccttacggtacggatcttacccagctgcccgctatgtacgaaagccatagcatcttgccaatgcggatcgctacgctgccattgacctacctgtactacgcggttgtatttttcggcagcgcgtaccatgatgttacattcttcgatactgttacccagcggtttctcgcagtacacatctttcccggcttcgcaggcggctaccatctgaaggcagtgccaatggtcgggcgtaccgacgataacgacatctacatctttgttgtcgatcagcttccgccagtctttgtagaggtgttttaccttctttccggtcagtttctgcgtctcggcagccctgtcgtttaacactttttcatcaatatcggccagtgcgatacattctacttccggattacggaggaaggcctgcaaatctgaaaagcccatccctttgcaaccgatcaggccgacacggattttgtcgttggcacccactgaattacctccagctttaataaagaaaggattcatagaaagtccggctcccaggatagctgcctgccggataaaatctctgcgtgttgtcatggtctataatgagttaatagtaaagatacacaattgttagtcagacaccaaaagtaagaataaagcccggtatcccccaataaaatatgtaataaatatataatgtagtgtacaaatccgaaaaagggaagtaaatttgcacctgctctcggcgaagagcgatgtatagagtattcacccaaaaagaaacaaaatgaagctgacacgcttattgacctgtcttttttttagtacaatagggttttcctgcatccaggacgaggctccaaatgcggaggccgatatcgaagaatgtattgtgccaagtgatattttgaaaagagatccgattattgtcaatgacaaggtaactctgatggttaaagctgatacggatttgaccgaccaagcccctgaatttgtattaactcctggagcaacaataactcctgccagtggcactaaacgtgattttacatctccacagaaatatgtggtagtatcggaagatggccattggagtaaaacgtatactgtagtttttactgttgcaggtattagcacccgctatgattttgagcatgtggagcagacgggtaagtatcagaccttttacgaaatggatgaatttaatgataagagacttttcgactgggcaagtggtaatcccggatttgcatttacaggagatacatcaggggagtttcctacaagctcttcagatgcaggaaaatccggtaaatgtctgaagcttcaaacaatgtcaaccggattttttggttcggcattaaagatgccgatagcagcaggaaacttatttatgggaactttcgatttgggaagcgcattatccggtagcgaaggtgctttaaaagcaactcagttcggtttcccctttgaacatattcctacttatttgacaggttattataaatataaagctggggatgtttttgagtcagcaggtaaacctgtagaaggtaaggttgatagatgtgatatatatgcaattttttatgaaacggatgataaggtaaaaatgttggatggaacaaatgcttttactcatcccaatttagtttccatagcccggattaatgatcaaaaagaaacggatgagtggacacagttctatcttccatttgaaaatatctctgggagattaatcgataaagaaaaattaaaggccggtggatataatattgcgattgtgttttcatcgagtttagagggggatcgttttaatggtgcaattggtagtacattatatattgatgaggtagaattaatttatactgctgaataataagagataaatattatgaaaaagaatatatcaatactatttttttgtttgagtttactggtgtctgtatctatccatgcacaaaaagatcgtaattccggcattataaagtctgctgtaattggtttagagtatgaagtgaaagcgggtttcagtataggtggtacggccccgattccattaccggaagagatccgggctattgatagttataatccgacaatgcagatcgctattgaagggaatgtaactaaatggtttgatacagcacatagatggggaataaatatagctcttcgtttagagaataaaggaatgaagactgatgctaccgtgaaaaactatagtatggaaattattggtgatggtggtgagaagctaaaaggttactggactggaaatgtaaaaacgaaggtgaaaaattcatatttgacagtaccagtgcttgttgcttatcaggtagctccgcgttggaggctgaaagccggtccttttgtttcttatgtgcttgagggagatttttcaggagatgtatataacggttatttacgtgaaaatgatccgactggaaataaggtagagtttaatgacggagcaagtgcaccgtacgacttctcgaaagacttacgtaagttccagtggggtgtgcagctcggtggtgaatggaaagcattcaaacacctgaacgtatatgccgatctgacctggggattgaatgatatcttcaagaaggatttcgatacggtttctttcgccatgtatccgatttatctgaatctgggttttggctatgccttttaaaaatataggatagttaatcaatagaataagccaaaagagatttctcttttggcttattttttaggtttaatgtttctattattatcagttttgaatgtttcattatttgacagttttgagcaatcattgaagctatccccttatcaaagagactccgccattacaggttcatttgccgtctgctttagctgacggattatttcctctctgaaaaataaatgtttttattgcttattatccgcacccaaaaagttgcatttataagttgaactcaagagatacgaaacttattcattgacccacttcgctttacaggaagaaacaggacattgctttctgtttcttagcgattcccaaggtatttcaccaagaaaagtaccacatttagggcaaacataatctattttgaattgatttgctatatcttgcagctgctgtggggtcttggatgcttgcttcgcacccagatagatacctactgtcggtgcacaaatggtaatgaacaaactcaatccaaacaactcaggactccccttacctaagaaacctattataacgcctattataccaggtaaagcaaaaggtaacgactggaatagtcttgttttgaattggttagcagattgtatcttaacttttgcttgaatataattatcatatacattctttaatgctgcaaattcttcactataatcattatttgatttcgatgcttcagacaagttcaatatatatccggttccaagcacgatcttatctgtcggtgtaacacgctttttgacgatctgtgagccattgacgaaagttccgttagtagagccgagatcttccaacaaccaacagccatgatcctcacgaaccagacaagcatgatgtctacttacatgaggatcattaactataaaatcattatcttcagctttaccaattttaatcttcatctttaatttcttttggttcttctgatttacccatctccctttccaacgattcttttagcacttttaaaggatctttggatattataagttcacgaggtttaccctcttcagttaataatagcagtttttgtttaggtaaattgatctgcaaaatatgatttttattgataatatgacttttcccaactctcattaatatcttgttacagccggctacctgcttttcaagaatttcttctattttaccaatattaatagcaaacgtaaattggatcccattggataatagtaatttagtataatttctgtcagcttcaaagtagagtatctgccctatctttattcgtaacaactcatccctcgtcttaattattaaataccgctccatacgttgatattgttttttttatttcatcaagtaacaaatatacggtattttatctttataccggcaataatttataaagaaatataaatggaaagaggaacatttatctgaaatattcctcttttattcttgaatcttaagtcgtttgacaaagattagttaacgtttaaatttcaatcgctctacccgaaagaggcaaacgaaggagctatattacttcaaagtaggataaagagggtttcccgtttcatccacttcagtccagttttttacatttacacttgaaaatgtaactgtattaccatctattattgcattaaacaaataggaatcaccagcttttagctctcctcccggaaccggaacatccacagtataagattttctccattaaccatcacatccatcgccccgggtacggaggagtaatcattgctgaaaccagtttattcaatttaattccatctccttccgttacttcaataacaacctgggttgctggttgagaaattatcagacactgcataaaaatcgaaaacacaattttccagatacattttgtatccatttactcccatcaatactcacggagaagatgttatatacaatcaagtgtgggatatgaggcttattaacacaaaagaaggatattctgaaatagaacatccttctttaacaggtataaatacgaagttttatccttttagttttgcttgaattacgcgtaataaacgagcctggattttcattaatgttgcaacttcttcactttcgaagtcgatatcggatatttttattttctgttctaccacgacatcttcattcttagaaccattctcaatttctacagataactcatccagctgagctttgattttctcgatcttctttgaaaaatttactttacgtgccataagtctttactatattaatagataaaatgaaatatttaatacaaatgtaattataatttgaagataacgaaataaataccttataatagtatatattttaaaacgaattaagaaggatattcaaaaagaatacccttcttaatttatcgatttatcacttatttattacagtaaatctcaatcttctatcgctgcctgcgccgctgcgatacgtgcaataggcacgcggaagggtgagcaggaaacatagttcaaacctactctgtggcagaacttaacagaagaaggttcacctccatgttcgccgcaaataccacatttcagatccggacggatagcacgacctttttctgtagccattcttacgagttgaccaacaccattctggtctaacacctgaaatgggtctaccttcaggatcttcttttccagatagataggaaggaaagaggcgatgtcgtcacgagaataaccgaatgtcatctgagtcaagtcgtttgtaccgaatgagaagaattcggcagaagaagcgatacgatcggcagtcaaagcagcacgcggaatttcgatcattgtaccaactttaaattcgatacgatctcctgcttcagcaaataacttttctgcggtgtcacggattactttttcctgttctttaaactcatacaagatacctgtcagcggaaccataatttccggtttagcaacaatgccttctttcttcaattccagtgctgcacctaagatggcacgtgtctgcatttctgtgatttcaggatatgtattacccaaacggcaaccacggtgacccaacatcgggttatgttcacaaagcgattcaacacgctgctggatagtctttacagaaactcccatagcaacagccatttcttcctggcctttcagatcgtgaggaacaaactcgtgcaaaggaggatcgagcaggcggacagtgacaggcagatcatgcatagccttaaaaatacccttgaagtcagcttgctgataaggtaagattttcttcaatgcattcttacgtccttctgcatcttctgccaggatcatttcacgcattgccttgatcttttcaccttcaaagaacatatgttccgtacggcataatccgataccactggcaccgaatgcacgggctatttctgcatcatgaggagtatccgcattggtacgaacctgtagttttgtatatttgtcagccaacttcatcaattctgcaaagtcatcggaaagttcagctgcagtcgtttctattttgccttcaaatatttctccggtagaaccgttgatagaaaggaaatcaccttctttcagcgtaacacctcctacttcgattgtctttttcttataatcgatattcaggccacctgcaccggatacacagcatttacccataccacgggcaactacggctgcgtgtgatgtcataccaccacgggctgtcaggataccttcggctacagccataccggcaagatcttcaggagatgtttcgatacgaaccaatacaatctgttttccggcagcatgccattcggcagcatcttcagcaaagaacacgatctggccggtagcagctcccggagaagcaggtaatcctttaaccaatacttttgcttttttcagagcagccttatcaaatacagggtgaagcagttcatccaacttattcggttcaatacgggccaatgctgttttttcgtcaatcataccctggtggagcagatccatagcaatcttaaccatagcagaaccggtacgtttaccgttacgagtctgaaggaaccacagtttgccttcctgtacagtaaattccatatcctgcatgtcacggtagtgattttccagtttcgtctgcaaagcatccagttccttatagatttcgggcatagcctcttccatagaaggatacttagcgactctttctgcttcaggaatacctgcacgttcggcccaacgttgtgaaccgatctttgtgatctgttgcggagtacggataccggccacaacatcttcaccctgcgcgttgatcagatactcaccattaaacaggtcttcaccgttaccggcatcacgagagaaacatacacccgtagcagaagtttcacccatattaccgaacaccatagcctgaacagtaaccgctgttccccattcggcaggaataccttccatctggcgatagaggatagcacgttcgttcatccatgagttgaatacagcgcaaacagcaccccacaattgttcataggcacatgtcgggaagtcatttccggtttgtttcttaacggcagctttgaatttagccaccaatactttcaagtcgtcaacggtcagttcgttatccaacttcacgcctttggcctcttttacttcttcgatgatggcttcaaacgggtcgatatcctccttactggtcggtttcatacccaaaacaacatcaccgtacatttgaacaaaacggcgataagagtcccatgcaaaacgagcattacctgttttacgtgtcaacccttctactacttcgtcgttcaatcccaggttaaggatcgtatccatcatacccggcatagaagcgcgtgctcctgaacggacagaaaccaataatgggttttctacatctccgaacttggagttcatcaacgtttctacattagcgatagccttttcaacgtccgacttcagtaactctactactttttcctggcccagttcataatattccgagcagacatctgtagtgattgtaaatcccggaggaaccggaacaccaattaaattcatttcggcaaggtttgcacctttaccacccagcagatttctcatatccgcttttccttcggcttttccatttccgaatgtgtaaactcttttcttttccatgtgtcagacagtttttatttattagatttcagttttgctatctctacattgcaatggtgcaaatatatgctatttgcgagtacacaggatatggaaagttaattaattttatatgttttataaccattccttagtattcatatcagctaaatatgtacatttgcgtggcgaaaattttaaacacagataaaattggcaagaaataagaagcagttacccttgttggaaaaggtaacaattacagacgtagccgctgaaggtaaagcgattgcacgagtgaatgacaaagtggtttttgttcctttcgtcgctcccggcgatgttgtcgatatccaactcacccgtaaaaagaatagttatgccgaaggtaaagcagtatactttcacgagtattcaacggaacgcagtacccctttttgtgaacatttcggtgtttgcggcgggtgtaaatggcaacatctcccctacaaggagcagttaaagtataagcacaagcaagtaatcgacaatctgacccgtatcggaaagataaaaatggaagagattttccctatcctgggatctgaacgcaccactttctaccggaacaaacttgaatatactttctccaataagaagtggctgacggaagaagaagtaaagtccggagctacattcgattgcatgaacggtgtcggtttccatattcccggaatgttcgacaaagtgctcgatatcaacaaatgttggttgcaggatgatatttcaaaccgtattcgtctttgtatcaagaactattgcctgacacacgaaggatatcctttctatgatcttagaaatcaggaaggtttcctgcgtacattaatgatccgcacagcatcgactggcgacctgatggttgtcgttgtattctatcatgaagacaaagagcgccgggaagctttattatcccatgtcgctgaacagttcccggaaatcacttccttattatatgtaataaatgaaaagtgtaacgacacgatcaccgatcaggagatttgtgttttccgtggtaaagaccatatcatcgaagagatggaaggccttcaattcaaagtcggagcaaaatcattctatcagacaaacagcgaacaagcctacaacctatataaggtagcccgtgaatttgccggactgaccggaaacgaaatggtgtacgacttatatacaggaaccggaacgatcgctaatttcgtatcacgccaggcaaagaaagtcattgggatagaatatgttcctgaagccattgaagatgcaaaagtaaattcagccctgaataagattgaaaacacactcttctatgcaggcgatatgaaagatattcttactgccgatttcataaaccaacacggccgtccggatgttattattactgatccgccacgtgccggcatgcacgatgatgtaatcaacaccatcctctttgccgaaccggagcgtatcgtctatgtcagctgtaacccggcaacacaggcacgcgacttaagcctgctcgatgtgaaatatgccgtaaaaaaggtacaacccgtagatatgttcccacatacgcatcatgtggaaaatgtagtattactggaaaagaaagaataacatatatataataatgtataggaaaatcgtctcccttttgtatatcgctttgcttttgagtagctgttccggcaataagcaacaagagcaaaaggaagacgatttggtgtctatggaccttccccaattgaaggctgccggcgagatcaccgccgtcacgctttacagttccacctcttacttccagtataagatggaaccgatgggatacgaatacgatctgatcaaagactttgcacgttccgaaggcttaaagttgaatatcaaagtggcggaaaacgcaacccgcctgatcgaaatgctcgaagccggtgaagctgatgtcgtagcttatcctatcctggtgaacaataaattgaaagaaaactacctttattgcggacgtgaagaacaaaccagccaggtattggtgcagcgtgccaacaaaggcgacacaatcctcacagacgtaacacagcttatcggtaaagacatctatgtaaggccggcgaccaaatactaccaacgtttgaaaaacctggatgaagaattgggtggcggtatacatataaaagatatagaaaaagatacgattaccaccgaagacctgatatcgatggtttcgcagggagagatcccctacactatcagcgacgataacattgcccgtctgaataagacttatttctggaacatcaacgtttcactgaaagtcagctttatgcaacgttcttcctggttggttcgtaaaaccagcccgaagctggcagaagcaatcaatgcctgggcctccgataaatcaggctcacatgtctataaggctgcgatgaagcgatatttcgagttaagtaagcaaccgctgaccgccgatctgccccccgtaaagaacggacatatctccccatacgacgacctgtttaaaaagcattccaagaatataggatgggattggcaactgatcgcttccatttcttatcaggagtcacatttcaatccttcggttgtttcatgggcaggcgccgaaggcttgatgggcattatgccgaacacagcccgggcacttggtgttactccgcacgaactgaaagatcccgatatcggtatccgtaccggagtggactgtttgcgaaagtttcgtcagggcttttcagaaataacagacccacaggaaaagatcaaatttacactggcttcttacaatgcagggatcggacatgtttacgatgcacaacgcctggctgagaaatacggaaagaacccattaatctgggaagataatgtggcagaatatattcgtctgaaaagcgatccggaatactataacgatccggtctgcaaacatggttacctgcgtggatcggagacattcaactatgtccgcgaagtattacaacggttcgactattacaaatcaaagaccagctaacatcaatcagtccagattttctgctatcatttcttttatggcaagtatgactctcggatgattgagcggaatgtcctcaaaaacacttagaagttcttccgtactcaatttaaattcctgctctccttttttatacataaaatacacattgatccccggattaccggttatcaacatagccactgtcccaggcaagtccccccagggcgggcaatctatatgggaggtattaaaacatgccgtaacctctgtaccttcccccggttgggatatgatctttacactcccgcctgtctgttccgcattctgaataaggaaaggtattcccaatccgaatttacgggttgtacgggttgtataaaacggactggtaacacgtgagactgtttcggcatccattccacagccattatcggcaatacggatcgtttcggtatcttcatcgatactgatcgccaaaagaatacgggttgctccggcacgtagactattggaagctatatcggtaatatggaatgtaagcgtattcatttattatagcggattagcggaatatattgcatggccccggctcttactgtaagccatcttcagattatcgaataaaggttccgaggcctgtatcaaacaaggtttagttcctatctgctccggatagtgagcatcggaagccggatacgacgtatagttcgaaagatacttctgttcggatcgtaaacgggcaaaacgtgaagcatccgtatattctatagcatctaaaggcaatgacggatcgataaaccccaactggctgatcaggctaaaggaaggccgctccacatgcgctgcaataaagagccctcccaattttttaacaaaggcagctatctgatttacattttggtcgagtgcagagatcagaagatatggggcctctcccattatttcatcgttccggttcacccaaacctgatcaccgaaacgttcgggatcattcaggacagtcggaagatgccggtcgagatattcctgaaaagcagaccgggaatcctcagttccgaacagagccagacaatgcgcttcctcacgcgtgcaaacttccgccccggcaaacaccgtcagtccggcttctacccccaaggcctgtatttcgcgacattgcaaagtactgttatggtcggttatggcaatgatatccaatccacgggcaagtgcagtttcgacaatgaccgtaggactcatatccagacttccgcaaggcgaaagacaagtatgaatgtgtaaatcagcccggtaaagcatcatctgttttgcaggagtcgatagatcttaccggaagcgatgaaagcagaaagcgatgtacccaatacgggaatcccttcatctctgcccttctgcaatgtttcttcatccggtgaagcaccgttgactaccaacacggctgccgcatctttcagtgtgccgacagctacgatattctgatgggtttgcatggttatccatagcatcccctcttccatatgtcccattacgtcactcaacagatcactggtataaccaccttttatctccgtatccaggttctcctcgccacagaaaacagtaagttccagttcttttatcagatcactgaccttcatattttgctcctttcttataacaatctttatttaaacgatctttcccccaggttttttcaatcagacgaaaggcatgttcctgatccagtttaccatgcttctccatgttacgctgcataaagacacagtcgctgaactgagcttcatggcgtactatatcttcagccaggctctggcagttcggatttccgcaagccccgcaatcgatacccggcaggtaacacatcaggcgacgtacctgttccatcttcttcaatacttcttcgatactgccatcataaagcagtttcggattaggctgaagcggacggatggtaatgtgctgtttcaaataagccaaggcaccgaaacgttcggaggcgtagataagcggagctttgtcgcgcttcatcgaccgtttcatgattcgttcggaagtcaggaagcggttagcaacggcaagcacacctccggcacagctacggtcgcaggctcgaagctcgagaaagtcaacattgcgaacctcgttggtggtttccatccgttccaggaaatcgatcacattatgtatttcatcgatggcaagacaacgtccggagaagtgtttagcctcccctcccgtttggctccaccgcatttctttcttagtaagtgccggcggaagaacacattcgggtttatagcccttcggacggttttgcaggatatgatataccttattatataatgtatccatattaatcaccccgttgatcgtggaagaatacccatcttcccctttcagggctgcaatcttggcggcacaaggcgtgacgtaaaagaggccgatctgctccggctcgtatccttcttccgtcaatacctggtggtaataggttgccgtagcattcaccggggtcttcaccagcaggatattatcgaccaatgccgggaaacggatctgtatcagacgcacaatagccggacagaaagaactgatcaccggcttctcttcggcaagttccatttgccggagcatttcgcgatggatcatgtcggctgtgaattctacctgatagacatgagtaaatccaagctcatacagcgcactgaatatctcttcttctgtcgtatattttgagaactgaccgataaaaaccgtaggaaccagggccacacggcactcgtaaccaaatattttctgaaagtcatcctgttccacagagatcgcttccgtcggacaagctttcaggcattcaccgcaatcgacacaccagtctttgcggatcacggcttttccatcgcggatacggactgcccgtgtaggacatttcgtcatacaatgggtacagccgatgcaacgatcgttatcgatcttcagtgcatgataaaatttggttttctccatgatgcattactcctttgttgcgaaccaggtaatcatgcgtacggtcgttcctacgcctaccttgctctctattgttagttcgtccacatttttcttcatattaggaagccccattccggcaccgaatcccatctcccgtacagccggtgaagcagtagaaaaaccttcctgcatggcctgggatatatcgggaataccggggccttcgtctttcaggaccagagtgatcttgtcggcatccagcgtagcagatacatttccccgccaggcatgggctaccacattgacttcggcctcatataaagcgacaacgatcctttttatgatacgggaatcgattgataattgctttaataccttctttatctggctggatgcatatccggctttcgagaagtttcccccttcgagttcaaaactaaattgcatgctgatttcctcctatctttaaaacacaggcaaaaggccgctgctatacaactcccccactgtatgatacatggaatgttccgtctccagcagaatcatattgttctccgccgccactgtcaacatctcgtctgtcgcccgttttcctctgacgaaaaggatacaggagacatctgccatttcggccgtacggatcgtttgcagattgcatagtccggtgatgagaattacttcattacaatccaccgtcagcacatcactcatcaggtcgctggcaaaagcgcactgcacttcatggtctagcttatcgcttccgcatgctacggtcgcttcggtaagttcttgtatctgctgaatcttcataatgtatgcaaggtttaatttcgtgacgccaatgtaagaaatattttttaatagatacctgttagtttatattaattactatctttggtagcaataaataaaattctaaagttatgtttagcaaagaaacgtatatggcccgcagggctaaactgaaacagactatcggttcaggtttgttgcttttcctcggaaatgatgaatcgggtatgaactatgcagataatacataccacttccgccaggattccaccttcttatatttcttcggactttcctacgccggattgtctgccatcatcgatattgacaacgataaagaaattattttcggcgacgaactgaccatcgatgcaatcgtatggatgggtacgcagcctaccctgaaagaaaagagtgaagctgccggtataaccgaagttcgtccgtttaaagaaatagaaacttatctgaaagctgcacagcagaagagccagcgcgttcattacctgcctacttaccgtgccgaacatcagatcaagctgttccagtggctgggtgtagtaccgggcgcagaacaaccttccgttccttttatcatgggtgttgttaaccagcgtaattataagacagccgaagaaatcgttgaaatagaaaaggcttgtacggtaacagccgatatgcatttaactgccatgcgtaccgttcgtccgggaatccgggaaagcgaagtggcagcagctgttgctgaagtggcttttgcaaacgactatcaactttctttccctattattgcaacaatcaatggccagacattgcacaaccacgaccatagcaatatgattaagagtggcgatatgctgttgttggatgccggtgcagaaacggaaatgggttatgccggtgatatgtcgtctaccattcctgccgactcaaaattcactacccgccagaaagatatttatgatatccaggtagctgcacacgaggctgctgtggcagcactgcgtccgggtattccttttgtagatgtttacgagttgtcttgtaaagtgatcatggaaggtctgaaagatcttggtttcgttaaaggtgatccgatggaagcagtaaaggcaggtgctcacgctatgttcatgccgtgtggattgggtcacatgatgggattggatgtacatgatatggaaaatctgggtgaagtatatgtaggttacgacggacagccgaagagtacggaattcggccgtaagtccctccgtctgggacgtaaactggaaccgggtttcgttcttactatcgaaccgggtgtttactttatccctgaactgatggatttatggagaggccagaataagtttaccgaatttatcaattacgaaaaactggttacttataaagatttcagcggtatccgtaacgaagaagattacctgattaccgaagacggtgcccgtctgctcggtaaaaagatacctttgcacacggaagaagtggaagcactgagataagcattatgcagttgcctggaataaatgaacttgttttatcactcgttctttactctacatagtagaaaacaacgttcaaactgttcaccgttcacccatcagaggctaatgcgttgtaaaacagttaataaaacgtttaaaatacaggtgaaggggttcctgaaaaggtgaagggttggcttaaacccttcactttcatttttttcatattacttattattagtacttatacttatgcccattagtccgtaagtcaggaccgattaagccaaacattatctcctattcgcttaacgacctgggtcgttaagcttaccgagcaccgtcatcaagcttaccgacaatggtctttcagtttataagttataactaaaggattagttggtagtaggtttaaagataatagacaataagaggaataatagaaaatccccgtaaagaagttattacctttctttacggggattttctattactccttatctttcttaataagcaaacatatcagcgttaacaggtatttctttaccatcggcagtcagtaccttcaattgaagcaggccgccgttgctgtcgaagtatttcacctggatcggatgcaaacctttcgctaatgctttctggcctaccacttcacgcggagagtgagggccgtcattatcgacaaccatttccccgtcgatcgtcagcgtacttccatcgtcggacatcaggttgaaggtgtaaatgccatcttcaggggcattgaaataaccggatacaaccaggccgatgttaccttttacatcagccgggatagttacttcagacacttcataagtgccattgaccggagccttttcaatatctgcacatttattgcctttgaactcatgccatacagcctgcaaacctttctttgaaggagttgcttctacggccggagcatattcgctcttgatataacgggtctttacgatatcgcctttctttccgttcggacggaaagtgcggaaggtaaagtctgttgtttccgttactttgatcggttctgtatactgcggagactctaatgtcgggatactaccgtcggttgtataatggatttctgcactcggatcaagacaagttatcgttacggttccttcgccaatgaaagcattcgtattgttgaaaccttccaggtccggcatacgataattcacattcatgatgttcaggcgcgggaactgtttcaccattctttccttgaagccgtcccagttctttacggaaggatcgctccatgccagttcggccattgccatcatacggggcataatcatgtactgtacccgttcgaacgacggaatccattcacaccacagattagcctgaatacccaggatcaaagccttttgtgcatcattcaacgattcgagcatcggattgaagttgtaaacgcccggcagggaatttttatcctgttgatagtcgaagtaaaaattagcgttcggtgaaaggatagcatggttaccttgtgccgttgcatcaggaaccgattgcggatgccaggtacgccaccacatgattgttgccgtcggagaaagtccgccttccaggatttcatcccaaccgatcatttcttttccgttttcgttgaagaatttctccatattatgaacgaaccaggcctgcaactcttcttctgttttcagtccgttatctttcatccgtttctggcaatccgggcatttcttccagtttgtcttttccacttcatccgcacccagatggacatatttataagggaaaagagggattatttcgctgtaaacatttttacaaaattcaagggccgagtctttacccggacaaaccggagaagagaaaatagatccccaccctgtttcattgaaacaggaaacacctgaatagttgcttacagcagccaacatgtgtcccggcatatccacctcgggaattacatcgataccacgaacgccggcatattccacgatctctttaatatcatcctgtgtatagaaacctccatataaagtatcgccctgtgttatacgtaacttcccggccggtaattcaaagtccggattatcctccgctttagcccgtctcaagcattcgcgatcctgactgttaaaggtacgccaggctcctttttccgtaagcaacggatatttctttatttcgatacgccaaccctggtcgtcggtcagatgccagtggaatttgttcagcttatagagagccatcatatcgagcaattctttcacttcttcttttgttgagaaatgacgtgacacatccagcatcatccctctccacccgaaacgcggtgcgtctgtgatctggacggccggaacaccccaggtaatatccgctactacttccggtgattcgatctctgccggcagaagctggcgaagcgattcgataccggagattacgccaccatatgtatttcctttgatctgaattttaccggaagacacatccaaagtataggctccttcgttttgccctgcaatatcactgactgcaagggaaatgtcgccatctccttcgcgtacattatatatatagccggttgcacgggataacaagtcggaaagatagttggctgccggtaataattgtttgtcggcaacaccgatattcataccgtctttcaatgtgaactcgccattgacattcttgatctgtttggggataggaataatagatacatcatgtgccacaggcgttgtgggcgaacatgcactcagcaataatgctccggtaagggaacaagctgcaaaaaattgtttgtacatttttattgtgtttatttgtttggtaataaattggaagcaaaaatacaaaaaaagagctgttcttgttgggtagaacagctctttttaaataataatctactgattaaatcttattcataacttcagccaattgatccggagttacatttgcggcaatgatcactcctttgtcgtctatcagaaagttcttcaaacccttttgcaggttaaactttccatacaactctgacttttttcccagttcttcacgaaattgctttgtgccgctaagcttgtctgcctttaccgtctcggtaaagattgattctttctcgtcgagagaaacagaatacatggcaattttatccgaacttagtttattaacttcattccataattgaacgttacgggctcgcgattcagcatcgtaagctgcccagaaattcagcaacgtgtaacgcccggaatgattttggaaactaatattactttcatttcctaaagactctattctcggagccagatcaccaggattagtacccacggtaggtctcgcttcttttgtagcggacgacattgttgccaatgcaaccgttacaatgagaacataagctcttaccttcataatgtaatttttacgttaaacttaatcggaacataatctcctacggataattaccggtctgcaggcggttctttgtcagttttcctttatgtccgactcctgattttcaggaaagtaaacaagtgcttttccttcgctaaggaattgcgttcttgtttttaacggtggcaaagatacaggtaaagagtctctccttccaaacgatataacataaatcgagtgaaatacaaggttttttatatgttttattgcatgaaaatctaggaaaatagctgttttatagcaggtggttaacaataatttgcttttaaaacaggggtaaaatagatgttattttaacatgagaaggaaaaacaagaacattaagtctggttttaaggagataaagtccgactataaatcggactttatcttagttttgttattctttataaggagaaggcataggcattccctcttttatatattcatcgtaaacgatcgtcggatggtcttgcagtgatgtcgtattatattccgctttgaaattatcccgacggaaattcttcaacttcaggttttccgtactgtaagtacgcaacgtttcctttttgtttcctgtcaatgaactttccacaactacggaatcgagaatgttcattttgggagtcaatgtaggtagtaacgtctgctccagcaacccgcggtaagcgccgatatattcacaccagtaagcgttgccttgcttaaaaacacgatacgtgtagttagaccatgctgttcggatgtgaatctcatgttcccagatttcaatacatgcttctgaatcatagttaggatctttaatcgtaactctttccaagccatgtgttttttcaactactttggttcgccatttgtctgaatgccgtatttcggcaataatctcaggcagcttttccttaatttcaaactgaattttcatctcgatttgcctgccagtcaggacttattaaggttgccaggttctaaattaaatataacgcgtctctaaaaataacaatttcatttgaatttttgtttatttatatggcgaaatttgcatataacttgtttacctttgccttataaaacaaaaaacatgggactaaaagacgaaattatactgataaatataaacggggctgaccgcccgggtgtcaccgccgcccttaccgaaattctggcaaagaataatgctgtcattcttgacatcggtcaggctgatattcataacaacttatcattaggtattcttttccagagttgtggaggaaattcaggtgatattttgaaagaattactcttcaaaagttatgaattggatgtaaatattcgttttaatcctattacagaagaagaatattccaaatgggtgaatatgcagggaaagaaccggtatattataaccattctgggacgtatgctgacggcaaagcaaatagcgggtgtcactcgtattgttgccgaccagggaatgaacatcgatgacatcaaacgtctgacaggacgtattcctttggatgaaaactcacggactccgaaggcgagtgtggaattttccgttcgcggcacaccgcgtgataaagaactgatgaaggctgagttcatgaaactctcctccgaacaggtaatggatatctctttccaggaggaaagtatgtatcgccgtatgcgccgtcttatctgttttgatatggattcgaccctgatcgaaacggaagtgatcgacgagttggctatccgtgccggtgttggcgaccaggttaaggctattacggaatcggctatgcgcggagagatagatttcagcgaaagtttccggcaacgttgtgccttattaaaaggattggatgtctctgttatgcaagacattgcagaaaatctgcctatcacagaaggggttgatcgcctgatgcgtattcttaaaaaggtgggcttcaagatcgcaatcctttccgggggatttacttatttcggaaactacctgaaacagaaatacaatatagattatgtatatgcaaacgagcttgaagtggtagacggcaagctgaccggacgccatatcggagatatcgtcgatggtaaacggaaagctgaattgcttcgtttgatcgctcaggttgaaaatgtggatatccgtcagaccgtagcggttggtgacggtgccaacgacttgcctatgatcagtatagcaggtttgggcattgctttccatgcgaaaccaaaagtaaaagcaaccgccaaacagtcgatttcaacgatcgggctggacggaatattatatttcctgggatacaaagattcatatttggaagaacaaatgtaatttaaataaaagcgtttatgataagacacattgtaatgtttaaactgacagagtttgcaactccggccgacaaacaggctaaaatgcaggaaattaaaacaggtttggaagctttgatcgacaaaatcgatgtattgcgcatgatccgtgtcgatttcaacgtaaatccggaagaaacctgggacgttattcttacaacggaactcgattcactggaggatgtgaagacatacgcaaaccaccccgaacacgtagcagtctcaaagggcattatcggtccggtaaaagcagacagagcttgtgttgactacgagtattaataaggcattatgaaagattttgatattgaagagcgggtaaaaaacgctgttcagaactttgaatcgggatacaactgcgcacagtctgtgttcctggcctattcggatgttttcgaactggatctgaatatggcaaaaaaaatgtctgtctcttttggcggcggtgtaggccggatgcgggaagtatgtggaacggtaagtgctatggctatgctggccgggtttaaatatcctgtattggaccagaatgaccaggaagccagaacaaagaattacgcaatggtgcagaaaatgtctaacatgtttaaggaaaagcatggtacgattatttgccgcagtcttttgcctgctgctgaagccaaccagactgttcctaccccttccgaaagaacaaaagaatattatgccaaacgtccttgcagcaaatatgtggctgatgcagcccggatagcaggacgaatgctgaaagatgaattggattgatggctcaggccatcaatcttatttgagaaacataccccagggttcttatttcactgaataagttcatgtaagatgattgtgccttaacatttactttataggtgatgatcgccttattcagttcatacatagattcaaacgaaacacttacgatataaatgtttttcccttccagtattttacggactgctttcagatccggagtcgacgttgtacaaataattgtcaatattttatttacaccgttcaggaacatccttctttcaagtctttccaggctgactaatataacgagtgtcagtcccgtaccaattaatgccggaacatacatccctgctcccacagccagtccgataactgcaacgacccagatacaagccgccgtagtcagtccgtgaatacttccgtgactctgcataatagcccccgctcccaggaaaccgattccggtaagtacctgtgccgcaatacgtcccggatctccattcagaaagtcaggataacattggggtatccagatggaaataagcatggctgccgctgaacccatacaaatcaaggtaaaggtgcgcattccagcctcacgacgacgaaactggcgttctataccaataacagctcccagcaaaaagctgacaaatagttttacagccgcagtagccggtgtaatggttgtattttggagtatctcgttaatttgatcaagcatatttattttccgttttagttattggcaaatatagctaattatttgaatatctctatatacttgccgggatggtatatcagataagataaagacttcggaatttcaactatttggggtaaatttgtcgcataaaaaagtggtatatgaaacaaacattgaaagaaaacggaggccttcctccattgatattatggacattatctattgtagccggcatttcggtagccaacctttactataatcagccacttctgaacatgatacgtcaggatctcgacgtatccgaatttaccaccaatctgattgctatgattacacagattggttatgcattgggcttattgttcgttgtgccattggctgatatgtataaacgtaaaacgatcattattaccaacttcactatcctgaccgtatcattgctgagtattgctttggctcccaatattcagatcattcttattgcatccttgtttacaggaatctgttcaatgataccgcaaatatttattcctatagcagctctttactccaaaccggaaaataagggacgaaatgtagggttggtagtttccggattgctttccgggatattggtatcgagggtaataagcgggctggtcggtgacctgtttggctggagggaaatgtattatattgcagctggcctgatggttgtatgtggtattgtcgtaattacggttctgcctgatatacagcctacttttaaagggaaatactcggaacttatgaaatccttgttttcgctgttgaaagaattcccctctttgaagatttatgcaatccggtccggattcgcattcggttcttttctggccatgtggtcgtgcctggcatttaagatgggacaggctcctttttttgcaaatagcgatgttgtcgggatgttgggactttgcggggtagccggggctttatcggcttcacttgtaggtaaatatgtgaaaaaagtgggtgtcaggcgttttaatttctggggatgcgggttgatcctgttttcatggttattgctttattggggtggaaactattatacttctattatagcaggtataattattatcgatataggtatgcaatgtatccagttaagtaaccaatcaagtatttttgaattatgtccgtctgcctcaaaccgggtcaatacgatctttatgactacttattttgtaggaggttcgttaggcacatttttttccggtacggcttggcagatgttcggttgggcaggaacagccggcgttggagtattactatgttgcgcctctttaagtgtgactctgctggcgaagaaataaaaacggagaggtttatctgggtaagcctctccgttttgtttatcaacttatattgattactttactttcgaaatttcaataacccggcttgtcagttgcttgcccgagaacactggaatacccactttcataagcagttccccggaaaaagtctttccgttgcatctcaggatagactctgtacccggcaccaggttgatttcctttacttcatactgtgtctcaggattcaatccctgcagacgaaccggctgtaaaatctcaccgtaacggggatgaacatcaaatgcaaaaagaacagccttatctgttgtttcattaacatacataactgctgaatgattgccgtcataaggagagaccaaacgatacaggtcaccgtccataagcgcaccacttaagcgattgaaattcttaaccgctcctctacaatactcttgctctgccggagtcatctcatgagtgcggatatcaaatccgagtttacccatcatggccacatcagtacggaactttatactggcactcttattccagcttgtaacatgtgcagccattgtctttgaaggaaagaaatgagaatatccccattggataaagatacgttcaacaggatcggtattatcgctcggccagaattccgtgaaatacttcagagcttcataatcggtacgtccaccaccaccggaacaaagcatcatcggcaggtttggatatttggccttaacacgttcaagcacattatagaatcctcttacatgttcgatataaagatgagattgttgatctttcagatacggagaataaatattagtgatcggactgttacaatcccatttgaaataggcgatacccggatattttgtcatcaggttgtcgacaattccaaatacataatcctgcactttcggattactaagatccaatacaagctggtgtctgaaataatattcgtctctgtttggcaaatgaatgacccaatctttatgtttttcatacaattcgctcttcggattaaccatctccggctcgatccacaaaccgaatttaatgcctttatctgttgcttccttcactagtttaccgataccgttcggtaatttttctacggtttctccccagtctcctaatccctgacgatcgctgctacggggatatttgttggcaaaccaaccatcatccaataggaacatatcgacacccaactccttcgcttcatccatgatatcgaccagcttgtcttcattaaaatcgaaataggtagcttcccagttattcagtaaagtaagacgtgatttatctccatcttttacctgatatttgcgagcccatttatgaaaatcacgactggctttaccctttccttcagcactgaaggtaaaaataaattcaggggtacggaatatctcattgggttttagtgaatattctgatgcatagtcatttataccggataggatacgtaatttgttttcgttgtcaacctcgaatgtaaaacgaaaatttccagtccaaccgatcgttccgaaaagaacttctccttcattttccctggcattttctttcagagacaataaaaagaatggggaattaaacatatttgcacggcttccaagctttgtatccaatacttttttcccaaatgaaagttgttgttcggtcatatttacttcatgtgcccaatccccagcaaattcagtcaggaagtatttttcactattcatatggagaagtgaagaagcatagttatatagtgtaacgggctttttctcctggtgcgaaatctctgtaaaagatttgatgatattttcttttgcataagaaacaaagtgaagatcgacggttacagggtatatgtcatccttaagtttgatgattgtttccgttacgtccggctgaatttgtttagtctcataagagatatattttagcaataaagaagggttaccatcattatgcaaaacacggatagccggttcaaaatagtcttccataccatgtgtaagataggcttcaccacccagaggcagttgatcgatatcactattgaaccggagcttctggcctagatacgattgatataaacggccattgttaccaaccttatatataaggctgatattatcggtcgaaattggaataataacgttgtcacctgcttttagcgacatagatatgaccagtaggcatatcaaagagaatagtctgtttttcatgttctttttttacttgattgtggtctatattttactaaaacgaagaaaagtgcctgttttggttataacagacacttttcttattgaaatatcatatttctaaagctccaataagttctctcgcggatttaaatccatgtctgtcgagatactcattcataccgtcaatcacttttatcgatacggttggatcaacaaaattgtaagttccgatctgtatcgccgtggccccggccaacataaattccaccgcatccttccagtttgaaatacctcctaaaccgatgacgggtatctttaccgccttgtatgtttgccataccatccggagggcaaccggcttcacacagggaccggacagaccaccagttattgtagataatataggtttacgcttctctgcatcaatagccattccaagcatggtattgataagcgaaacagagtctgcaccttcggcttcgactgcttttgcaatctcagttatatcggttacattaggagaaagttttacaataagggtcttgggataaaccttacgaaccgccttcacaacttcggccgcaccgcaggtcgttacgccaaaagccataccgccttgcttcacattcgggcatgaaatattgagttcgatagccggaattttatccagtcctgctatcttttctgcacattccacgtatgtttcgacagacgatccacttacatttacgatcatatttgtgtcaatatccttaattgaaggataaatgtgatccacgaaatattgggctcctttgttttgcagacctactgcattcaacatcccggaaggtgtttccgccatacggggatacagatttccttcgcgtggttggatggttgttccctttacaaaaataccacccagtcttgaaatatccataaagtctgaatattcgactccgtatccaaatgtacccgaagcagtcattaccgggtttttcaactgcaaattacctatgtttacatttaactcagccatgtcaatttctctatattaaatacaggaccttcagtacaaacacatacatgaccttcttttgtattctccacacagcataggcaagcacctataccacaggccattgtattttcaagcgaggcttcgcatgtgatcgattcagtagcggcatatctggcaacagctaccatcatcggcttcggtccacatgtgtaaattctatcaaaatgaatgtttttcaatacggaatggtttgttacatagcctttttcaccgagagaaccgtcttcggtagttatgtgaacagttcctatcttcgtaaactcatccagttgtaatacatcatccttagagcgtgctcctaacaggaatacaggttcaaaaccggcattctttaaggctgatcccaaacatagcatcggagcagtaccaacaccaccaccaatcaacagaaacttctgatttttactttcaccggtaggaattgtaaaactgttacccaacggcaacataatattaacaatatctcccggacggtattctgccatacgacgtgttccatcgccaaccaactggataagcaaccacaattcattggttgttctatctataaagttaattgaaataggtcggcgaagaaatgttgtaggagagttatccaccagcacctgaacgaactgaccgggaagcatttccggcaaagtatcgtcgctggttaattttagcaggcaataatttttatgaaggcggttgttttcagtaaccttcatatctaacatgtacttcttcatataatatgattactcaatttctatacaaagatacatgaataagatgtatatagcaatgctgacctagtctttcttgtttttttcaggagtaaaagtctcaaatgtattatctgaatagaatatcattattttactcacatttctggatggttgttcaggaagcacaatttgttctattacaggctgtttaggcatatttacaggtgtctcaaccctaatttccttgcgatattccggagaatccgatagaatggacggttttatcgtcgtatttgtaaacaaatcgggctcagttaacacatgttcgcgcatcatattgcctttgccgaataaaagccagtcggaatctacatacgtaaaccgttccagaatttttaccagcacatccaggctgggattatttctaccggatataatatgtgacatagctgatcgctggataccgattgcttcggcaaatttggaaggagttagtccttcatgttccattactgctaaaatacgatctttcataatcaaaatatggattatatatcaaaaatagctgccaatatgactgtttacaaaaattcaatacagaattaaaccatgacacaaatataacatattatttccaattgtgcaatttatatttataatcatgaacggatagaattgtaaccacagataaacatttgtatctgatacgtttgtaaacctatacaaaatggcacaaaacaaggttaaagcagtgttaatgaatttatataataaatacctgttgtataatggattatcacatcatttattgtaaaataaagaagctatttcacatttatatacggaatcattgacaggaattaatgtatacaattaatacaccggggtaatgagctggtttttgatatattatcatatatatttactgtaacagtatttaaacctattttcattgatttatattagtaatgtatactgaaacatttgtatcgccactctatatgacacaaaagtaacttttaaaagtatttaaatgtatacatatctttttgattacaaatgtttcactttgaatattgtacacatttataaattagcatcttttacttagagggccccactgtcaatatgtcttgttttttgttacaactctttctctacgtgatatgcttttgtatcctacaccctaaaagcttattttttcgtgatatttgtaaacaactatacgagaagatataaatattaaattctcaaaggggtaaaacacaggtgaaatcattgaaaaacaagataggcaccctgcttttttatgttcgaaaatctgactgttctagaaaaataaggacaaaaagccgttgttaggacttgttacggccagaaaagaaaaaactgcacatggcgaattctgaagttatcgccatgtgcagtttacactactgattctatttttaatgaagtattttatataataattctttgagtaaatcagcatccgatacagaagaattgtctactccttttgatctggcatcggttgttcgaatgtcgctgatcaaattaaaaactttcatggccggataatttcttaatccagtcatataatccttcacctgaaaagttccccttaaacctaaagccgtcattaaaccagcttccgatctgtcctttgtataataacagatcaacaggtttgagaaataattaaaaattacaggaagggtcatctgtatcggattacttttcggattcttttcgaaatactgaacaatccggtttgcttttaatatgtcctttactgcaatcgcttttattaactcgaagttattgtattctttacttattccaatattttgttcgatcaactccggagtgacgcgttttgaggccttttcaggcaagatcagtgccagcttgtccaattccttacttaggcggcttaaatcgttaccaaggaagtcggaaagcatttgagcagcctttggatcaatcccgatggaatgctgttgcataaacgaaacgataaacgccggcattttataatccggtatttttttcgattcaaacaaaacgcctgttttttcagtcgctgcagccagtgactttcttctgtccaggttcttatatttgtaattaacaaccagtaccgtcgaattaagtggatttttgacatagttggtaagcaattctatgtcgcggaccagttgtgcttcacgtacgactaccaactgatattccgacatcatcggaaaccgacgggctgcatttataatcatagccgcatccgtatcggccccatacattaccatttgattgaaatcccgctcagattcacccaacacattttctatgagcagatctgttatcctgtccataaaaaaaggttcttcgcccattaatatataaacgggctgaaactttttagcaacgatatcccggcatatttcctcaaacgtattttctttttttgccataataaagcattaaatattaccaactgaaccgaatatgacggactgtttttttatcatctataatttgatgaagggcttctatccctaattttacatgttccggagcaaaattgcgggtaactgcccggtcgcttgcctctgttttaaccccatcttcttctaaaggtttatctgatatcatcaataaagcccccgttggaattttattggcaaagcctgccgtaagcaaggttgctgtttccatatcgataccggtggcatgcgtacgcttcagatattccttgaatgaagtgtcgtattcccaaacacggcggtttgttgtataaatcgtaccggtccaataatcttttccctggtcgcgaacagcagaggaaatagcacgcaacattgaaaatgcgggaagcgacggaacttctgccggcagatattcgttggaagttccttcaccacggattgcagcgatcggcaaaacataatcacccagattattggctttctttagtccaccgcatttaccgagaaacagaaccgcagttggactaacagccgacaacaaatccatgatcgttgccgcatttgcacttcccattccaaagttaataatggtaatgccttcggccgaagcattcggcatagagcttttcaacccaagtatcgggacattaaaattttcagcaaatagctcgacatatttggtaaagtttgtgagtaagatatacttatcaaaatcttccagcctacgctcggtataacgaggtagccaattttcaacgatttcttgttttgttttcataaatcattacctttgagggtagaattatagtgtataatataaacgacaaatataataaatgctatcattaaacctgccaacattcgcagcgaaagtaaaggaaaaagacgggaaacctgttatattcgatcctgtacgccgcaaatatgtagctctgacgcccgaagaatgggtgcgtcagcattttgtcaattatctgataacagacaaaggatatccgaaagaacttctggcgaatgaagttcccctgaaactgaatggaacatccaagcgatgtgatacagttgcatataaccgttttttagctcctttaatgattgtggagtataaagcccccaccatagagataacgaaggctgttttcgaccaaatagtacgttataacatggtattgcgcgtacgttacctgacagtcagtaatggcatcaaccatttttgctgcaaaatcgattatgaaaaccttacttattcttttttggatgggcttcccgaatatgggattctggaagtctgaaaattgaaaggaaaaggcaataacatcattcttatttacctgaaaagggtacagataaacaagtatttagtttcttccacaaagcctctccccttatccttcagcatatctctgccggataagggttcatccccccaatcggtacctggaattttttatcagatatttgctacatgatgtatgaggaataatgatcattttatcccctgcaaaactgtcctgcttccccgcaaaaacagaatcagaaataaccggaataatacaaatcacattattaattcgaggtagtcggtttatcttaccggccaataccggcaaacacaaaaaaaacaatactccaaggagcatagctatccaaaaatcagaagtatatatggtgataaaagaatgtaacatttccgtatattaagaattatacggaacaaacatagcaatatttatttaaaaaacaaacttttgtcgaataaatattgctattatgagtagttttcttaaaaaaggtctataacgcgtatgctgttctgtcgcgatatatttcaatagagtcaattcgctgtgtatctgttttttgaatatacacggaattgtcaacaccatggataggctgctgaatctcttctttttcattgaaaagaagagaataacctagtattactgcgaaaaaagatagaatcaacaacttcataatcttgctcaattttatgtctatattagctaagatgtaataagaacggaaaatgctgcatgatattacaaaaaaagggaagaaaatattatttcttccctttttatttattgaggcttgtaaatacctactgttttatgcaccaaaatcatcgaagtgtaacatttcgcgaggtacacccaggttgtcaagcatattttctaccgctttcgacatcgggcccggaccacacatgtaatattcgatatcttccggagcttcgtgatccttcagataagtatcgtaaattacctggtgaacaaaaccagctgtatacttcacgcctgctgcatcagctgctggatcaggacggtcaagtgccaaatggaatttaaagttcgggaattctttttctatttccaggaagtcctgcagatagaatacttcattcaatgcacgagcaccatagaagtaagacatcttacgatctgtagtcttcaatgtcttagtcatatgcatgatctgagcacgcaacggagccataccggcaccaccgccgacccacatcatttctctcttagagtcgaagatcggatggaaatcaccgtaaggaccgctcattattaccttatcacccggtttcagggtaaagatataagaagaagcgatacccggcatgatatcctggaagccaggaccctgatctttcggtttgaaaggaggagttgcgatacgcactgtcaacatgatacggtcaccttctgcaggatagttggccattgagtaagcacggatagtcggttcagtgttctgacatttcagaccgaacaaaccgaagttcttccatgccggcagataaccttcaccgatcaggtctttatcgatatccttgtcataatccatagaatatgcagggatcttgatctgtgcataagaacccggaacgaagtccatgtgttcacccttaggcagagcaacaataaactctttgataaaggtagccacgttcttgttgctgattacttcgcattcccattcttttacaccgaatacttcatcaggaactttgatcttgatatcttcttttatcttggtctggcaacccagtctccaatgatcttttatttgtttacgagagaagaaaccaacttccgtaggaagaatgtttccgccaccttccggcacctgacaacggcactgtccacagctaccgctaccaccacaagcagacgacaggaaaataccttcactctgaagcgtattcaatacagttcccccgatgggaacttcgtattccttttctccgttaacaaccatcctcacattgcccgatggtattaattttgctttcgcaaataaaagcgaaccaacaaggatcagtgtaatcacaaggaaaacaacagctccgactgcaatggtaagtccgcccgacattaatataatcatctttattcttgtttaatgcgttaatacttagatcttaagtcctgagaagcacataaatgccatacccatcagaccggtaatgataaaggtaatacccagacctttcaaaggcttcggtatatccgaataagccagtttttcacggatagcagccataccaacgatagccagcatccaaccgataccagaacctaagccgtatacagtagcaactcctacattaggaaatgccttttgttgcataaacagagaaccacccaggatcgcacagttcacagcgataagcggcaaaaagatacccagagatgcatacagtgccggagcaaatttttctacgatcatttcaaccaactgcgtaaatgaagcaatgatggcgatgaagatgatcagagaaaggaaactcaggtttactcctgcatattcagcgcctaaccaactcatggcgccttctttcaatatataattttcgagcatatagttgatcggtaacgtacataccaggatgaacgttacagccatacccaatcctaaagcagtctttacgttcttggaaacagccaggaaagaacacatacccagatagtatgcgaaaatcatgttgtctacgaagatcgagcggacaaacgtgcttaaatattcttccattctattattcgtttaatagtttgtattaattttcttgaagctctttgttcttagaacggtgaacccatataatcacggcaatcacgatcaaagccatcggaggcagaatcatcaaaccgttgtttacatagccgaagtcgtagaatgcctgcgggatcacctggaatccaagtaatgtaccagaacccaataattcacggaagaaacctacgatcaccagaatcaaaccatatcccagaccattaccgataccgtccaggaaagattcccatgggccgttacccagggcgaacgcctccagacgtcccatcaggatacagttggtaatgatcagaccaacgaacacagaaagctgcttatttacatcataggcaaatgctttcaatacttcacttacaatagttaccaatgcggcaacaaccaccaactgtacgataatacggatacggttaggaattgtattacgcagtaacgaaataatcacgttagcaaaagccacaacagccgttacggaaatacccattacgatagacggctcaagcttggatgttacagccagtgcagagcagatacccaacatctgtacgatgacagggttgtttgtgctcaacgggcctaacaatacttctttatttttacttgacattaatcccatctcttactgattttgtgaggttaaaaacttaacataaccgttcaggctattgaataacatgtgatctaccccctggctggtaattgtaccaccggaaataccgtctacataatcctgaccggcaacactcttacccggcttaacaatcgctacggatttgaattcaccgtttacaaacaatttcttacccttaaattcattgctgaaagcaggtttggcaatttcagcacccaaccccggagtttccccctgatggctgaagtctgtaccaaaaattgtatttttgtcattatcaacggaaagatatccccacagaggtccccacaaaccagcaccagacaaagccatgatgtatttgttttgaccatctacactggctacgaataccggatgttgttcaggtgttgcagtaaatgcgtcaccttctaccttttctccattttcattcacaaggaaagattctttgatcaattcattgtattttgcttcagcttcattggcaggaacagatacgttgattgaacgcaggatctgttgtctcttgtcgttatcttcattctttttctggaaacttctcagcgactgcgaagtgaaagctaacacaacagcaaccagaagaaccattacagaagcgtatactacggtatatacattactatctctattcataattctacttcttattataatgttacttcactgctcttttcaaacgacgtgtgatgttgctttctaccacatagtagtcgatcagcggagcaaatacattcattaacaggatagcaagcatcataccttcaggataacccgggttcagtgcacggataatgatagccatcgctcccactaagaatccataaatatatttacctgtttcagtacgcgctgatgttacagggtcggttgccataaacacggcgccaaaagcaaaaccacccaggaacaaatgatcgatcggagatacacacattgcaactgtagtaccgatcatattgaagatagccgccatcaatgcaccacctacaaatacagacagcattgtcttccagcttgcgatctgagtatacagaaggataacagcaccgatcaggatagccaatacggatgtttcaccgattgaacccggaatcaatcccaggaacatatcccatgtagacagtgggttacccaacacgtcaacagtctggaatgaaccgatcatgtctttaccggcaatagaaacctgccccagcggagtagctccggagaaaccgtctactactgttcctgcacccagtccgaatgtatcggctgtgcgaacgaatacctggtcgccagacatggcagccggataagcaaagaacaggaatgcacgtgttaccaatgcaacgttaaatacgttataacctgtaccaccgaacacttccttggcaaaaacaactgcaaaagcagtagctacagcgatcatccacagtggagtatcgataggaacgatcatcgggatcaatataccggaaaccaggaaaccttcctgaatttcttcttttttcacctgggctacagcaaattcgatacccagacctactacgtacgaaacaataattttaggcagtacagccaggaaaccgaagatgaatgtcatcaaaaatccgggatcagcaccaacagccagattgtgttgatagccgacattgtacataccaaaaagcaaagcaggcaacaaagcgataataaccacagtcattgtacgcttagaatcgatatagtcgtgaatatgcacgcctgatttcgaagtggtgctcggaacaaataaaaatgtttcaacaccttcgaatacagaacggaacatcgccagctttccgccttcctcaaagttaggcttaatcttgtcgaggtaattccttaacgctttcaatgtattctaattttttatgttattaattcatttccttgtataacagatccaatccctgacgtacgatcttctggatctcgatcttggaagtgtcaacaaattcacaaagtgcaaaatcttccggggcaacttcatagatacccagattttccattttatcgatatcgaaagcgataatagctttcagcaggtattcgggatagatgctcatcgggaatactttttcgtattcgttcgacatgatcattgcgcgtttacctcctttgatacgtgcatcgattacatattctttgctcttaggagccaaccaggtaaagaaagaatggcttacactgtattttccgaatcccggagttgcccaaccgaagaagtcataagttttgtctccttcagggattaccgtgatctgattatcgtaagcacccagatattcgtctttacgaactttcgttccggtcagcacatttccgctgatgatacgaagatcttccttgccctccaggatctttcctgcaaccagactgtcgatcgtacaaccggaaatagttttaacgtatcctctttctgttgtttcagaacctgtgatagcaaccaaacggctgaaatcagctacacctttgttgaacagacgaccgataacgatcacatctgcagggtttaccacccaaactacttcgagtttgttcaccggtttgatatggttgatctgtacccctacattacctgcaggatgcggtccttcaaactctacagtttcaactcctttcacatttacggaagaaccttttctgacaccgacatacactttacctttggtaagttttgccagtgcatccaacccggtctggaaatcagcttcctgtcctttcaaaatgaaatcgaaattcggagccaacggtgcagaatagaatgctgacacgaaaatgtcacgcggttcatctgtcggcgttgctacgatatcgtacggacgctgtttgataaaaggccacataccaccattgagcagggcttcttttacctcttcacttttcagtgaagacacatttttcttaccgaaatcctcgtactcgatctgcgtgtccggcttaacaacgatgctaagcactttacgcttctctcctcggtttacggcagttacttcaccgctaacgggtgaaacgaacttgatctccgggcggttcttgtctatcatcaatacagaaccggctttgactttttctcctactttggcaacaactttgggggtaataccgttataataatcggggacgatagcataactgtcgcttttcccggtgtttaacagtacgtccgaagctttacccttcagattaatgtctaaaccctttttaatcttaatcacatttgccatgatacaactaaaattgtttatatgtaattttcccgcaaaagtacataaatttttatgctttaaagcaggattaaagaaataattagagaaataattccataattttgtaccgtcaaagaaagagacatgaaaatgagagtacattgtttattatttttgttgttttgtgccgctgtaatgcaggccaatgctcagcaaacgtactttaccgacgttaatagcaagctgataaaaacccttcaggtgaaggtggcaggagagtttatttccgagccttatatcgagttgaatggcgaccagcagatccagatcaacttcgatgcgttggaacagggtggtgtccgctactcctattctatcatccattgtgatgccaactggcagaagtcattcctctctcccattcaatatctaaatggttttcagggactaacaatagatgacttcgccaattccatgaacacgacaacgcagtacacaaactacaatctgctgttgccgaatgacgatgtgcaattcaaagtttcggggaattatgccgttcagatctacaacgaagacatccctgaccaaatagtcctcaccgcttgtttttcagttgtggaaccgatggtcggcatttcggcttccgtgagtggaaatacggacatcgatacgaaccagactcaccagcaggttagtttcacgatcaataataaaaactttccgataccttatccgcaaacagacctgaaaatacatgtctatcaaaacaaccgacgcgataatgccgtatcagggcttcaaccgacgactattcttgaaaatcaaattggctatacaaacaaccgcagtctgattttctctgccggaaatgaataccgccgtatggaattcctgagtacaaaatataacgggatgcacatagaaagcatatcgtaccacaatccctattataatgtagagttgatgaccgaccataaacgatccggccaaacttatcagtacgaccaggatcaggacggtcgtttcttcatccgttgcagtaattgcgacgatccggatacggaagcggattattgcatagtacatttcgccctggcctgcgatcctttcctcgatggaaatgtttacctgaacggagaattattccataacgtactggatgaaaagagcaaaatgggatataattttgaaacccatcaatatgaaaaggcagtactgcttaaacagggaagctacaattatcagtatctttatgtaccgaatggcagtaccgtgggcgaaaccggtcctattgaaggaaactattaccaaacggaaaacgaatataatatttatgtttattaccgtccgatggggactcaatatgaccgtttaatcggcgtaacgacggtaaaaaatgcaatgcaggtattttaaagatatatgaaacaaacatcccgatatttcaatgaataaatatcgggatattccttttatgaaagccaatgtgattatttcttccttataataactacatcctgaaaatccagcggagaagcgccatgagaccaacttccctgatgtattgactcggcatataaaccattcttttccaacaacgaattcagatatgattcatcaaaagcgatattagcctcttttacctttttatccatcaagctatatccgtcaaaggaatgaagaaacttaaattcaatcacatcttccttcatttgttgttttatctccggagttaacaagaagaatgtagctaaacattttccatcttgtttcattaccttggaaatctgccccagataattatcgacgtcatccggcatcatatgcgtaaaaacggaagtaagcacgacacaatcaaatgttttctgaggataaggaaatttaaagtccttagccttatcatccgtacttaaattataaaggtcattttttaagtctatgtataaaaaatggaagttggggaaactaaccgttattttctttttgcaccaatctattcctttttttacaatgtcaaaaccatcatactgcccatctgcattcagataacgggttaaaggaacagctaaacgtccgataccgcaacccacatccagaattttgccagacggttttaaatcggcatacttaataaccagatcgagcaaatgatccccttgcttcttaaaatcacccgatccgataaaaatcattccacgcataggggtcattttatccctttttcccgtaaggccttcataaaaatcaatagggagatagaacaatcttctcaccacaaaacgtaaagagggtgagaaagcataatatagctttcttgctattttcataatatcgtcattttaatttttttgttacaatcattctttagtaaacgaagagtcgatacaaaatattatatagagcaaccgaatatttaccagaatatccaatgtgtcaaattgctatttctgcctatatatagatcggctgtacccgacaaatacgcaacaaccatattttatcaaatcctcgccaggttactatatgtcagatagctgcattatgcaataacattacgacaaaccgatattggtattctgtctattatgtccttttattgcgaaaatagataataattatatttttgtcattctattttaaacctctttaagagatcatctggagaataaaactgctcaaaaacatactatttaagccaaacaatgcatccaaacactagctaagcaacaccttttaacacatttctcgctttaaacaaagcatcattttgtttaaaacgggaaaacactcgttttaaacgaactgataattcatttaaaacaagtttgaaaaaaggatctgtagcgatatttgttaattattgtaacaatatatcttctaaaaacgtatttctgaagctactcatggatattttccaccgcaaacacccagcatattaacaccaaaacgaagatattagcatcattttgctaaaacaccaccatcgacttagcagagcaaccagcttttagcatacttggggagatatataatatcatccatcatttctttagtcggttataaaaagatgaaataaaaaagtatctttgtaagaataagaatcctaaaacgcaattatcatgaaaacagtttttttatcgacattagaaaatagtttccaggctggtcttttgaaggatttactgatcaatgaaggtatagagtctttctttaagaacgaaaacatatctaatgtattggggaatatctccggttttcagctagagatatatgtttttgaaaaggattatgagagggcaaaagaaattctgaaagaagctcttccacaactagtgggagaataaatgtacaattttataatcctgaatgaacagacaatccctttattcttctattatagcggctttctcaatagcagttttactgattattgtacaagttgttccagctaagcctttgcttttattagaacgattattccctttaggcggttggatacaaattaatatagccatcatttatggagcactgctttgctataaaatgcaggacaggaaagaacgcccgaaatggagaacaagagcctggctgcttttctcgatagtctttttcggacagttgttgttaggtatactggttaatccagtattcctcatgaccggaaagttacatttgcccgttccggcagttattcttgcaggaccattatacaggatggaaggattatttatgcctatactttttttgagtacattattgctttccggaccggcatggtgtagtcaactttgttatttcggggcatttgatgcctggagtgcaaaaggaaagacggataaaaaaccttttcgttatcatcgccagctacgttatagtgttttgtttctggtaattgcaggagcaattattttaagattgaccggggctgaaggttggatagcgacacttgcaggaattgccgtaggattgatcggactactaattatgctgttgttatcgcgacgatacaggaaaatgatccattgcagcagctattgccctatcgggacgttagtctcatttatgaaatacctctctcctttccgggtaaaactgaataaagattgcacacattgtatggcctgcttaaaagcctgtaaatatgatgctttgcataaagaaaatatagaaaaggggaaaatcggttatacctgtacgtattgcggcgactgcctttctacctgtaaacacggcggattggagtatcgctttttaagactgcgtccgaccacagccgaacgcctttggatcattattacagtcgttttacatacctgtttcctgatgattgcacgcatctgaaagatatacagggcgtcccatcaaataagttgccgctatattacggtcgtcgcccagtgtttgaagcccaaacagtttattttcaagagtccatttcccattacgttgaagatattctttccgtatttgctgagaagatgttgccgtacaatccactacaataaaatcggcttcacggccaggttcaaagctacctattttatcatccagcatcaaagctttagccgtgccacgtgtacatttatataaagattcgaatacagacatcgaataaccgttcaactgttgtatcttataagattctgccattgttttccaaagagaaaaagatgttcccccacccacgtctgtggcaagcgttgtttgtatgtttatacgattagcctgctgcatattaaataaaccacttccaagaaacagattagatgtcggacaatgagctatgatagctccggcttcagccattcgtcggcattcggagtcggaaagatgaatgcaatgtccgaatacagaacgatccgtcaccaatcctgcacgttcataaacttccagataatcctgacattcaggtgataaagaaagagtagagtctatttctcccttgttttccgaaagatgtgtttgaatataagtatcaggatattcttcgtgtaaacgggcggcagtgatcaattgaccatgtgtagatgttattgaaaacctgggagtaatgacataaagattacgccctttcttatgccaggattcgataagtgcacggctatctgtataaccactctccttcgtatctgttaatgcctgaggggcattacggtccatcataacttttccggtaagcatcctcatattatattctgaagcaacagaaaagagcgcatctaccgaggttttatgaactgttgcataagccatacagcaggtcgttccattcctaaatagttcgttaacgaaaagcctggcaactctttctgcatgctcttgtgatgcaaatgcttcttctgtaggatatgtatattggttcagccagtcaagtaactgttttccatacataccgatcatttccgactgaggataatggatatgcgaatcgatcaatccgggcatcagtaatttccctgaataatctgtcagatatgcgttattatatttatctttgagcctatcatatggccccgcttccatcacttttccttccgatacaaccaaggctccgtccggataataacaataaaaatcttctgttttcagaggcgagtctttaaaataaaagacttctcctttaaatatctgtattgaatcgttcatttgtaaaaaggtggtgatagtccaggagtttcgtttgaaaacaaaactcctgactatatattacatgttaacttgtaaagctgctgcaacttcatctgcgatttcttcgtcgcggagagatttcagaatggctaacccaaactcaaaaacaaatcccggacctttacaggttatgatgttaccatcctgttctacaccggtataggttgctgttgctcctatcatggtaggttcgaaattaggaaaacaagtagctctacggccttttaacaggcccaagcctcctaaaaccataggtccggcacaaatagcagccaatattacgtcttcctgatattttttcaggataagttccttcaggcgtgtacaggtattcaggtgattactaccgggaatacctccgggtaagatcaaagcatccactgcactgaaatctgcttcttcaaaaacaaaatcagctacgacaggaatgttatgtgcccccattaccttcaattctcccataatagagacagttgataccctgatacctcctctgcgtaatatatcgacagtacctagtgcttctatttcttcaaatcctgttgccaggaatacaaatgcttgtttcatatcttctctttgtttttatttaggtaatatttgattttatatttcaataaaggtatgtcaaccggtttgaccaggtaatcatcgaattgacagtctttagccttctctttttccttatcgaatgcaaatgcagaaagagccagaattgggacatccggagaaagtctccggatatcgcaggttgcagcaaacccatccattacaggcatctttaaatccatcaggattaaatcgggtttataaatcttaaatatctgtactgctacttccccattctccgcatagatcagacgatactgctgcttcagtacagcctgtagcaaaaggtaattttccagtacatcttctgcaacaagaatagtaaactgccccggcaaagcgtccggaatgatctctgtcggtaccttatcgtctttttcgtttagtgcaggagccgctgaatcggctataggcaaagtgaaccagaaagtagagccttttcctaattccgacctgagccctatttctccacccagtttttcaatgatcattttacaaatggataaacctaagcctgtcccctgtctgaaatcatccagttttacaaaccggtcaaagacagaagcttgcttctctttggcaattccgatcccggtatcggtaacagaaacacgaacaaactctccttcaacttcgtatgacaaagagacaaaaccctgataagtacattttattgcattggagagaagattgagcaatacctgttcaacacgctgtgtatctgtctgtattctaacagaaggcaacaaatctccatgaaacaataaagcgacatccgatgtcattttcagggattgtgaaacatatacttcatgacagatatctttcaaatctacccatgaaatattatagttcaatgttcctgattctatttttgcaaaatcaaggatatcattaatcagctggagcaacaaatcactattattattgattattgtaagaaattcttgctgctcacttgcattatccgtttctgtaattaatctggagaaaccgacaattgcattcagaggcgtccgtatttcgtgactcatattagcaataaaggcattcttcatcttatcagcctcttgcgctttaatcaggtccagttcgttttgacgttgttcagtaatatcccaaagcatagccaacaataaaggggaagctcccgggtccggattcgtaattaaaaggcgaaccatatttacaacacggatctcaccattaggtttctcatattcgatcatcgacttatccgatcttccatgatttatggtagaataatcttccgtacgaatttcatgggctcttcgcggatcggagaaaatatcaaaatctgttttcccgatcacctcagaggcattcacccccataaagtcttctgctgcctggttaaaatagatatatttgaagctatcaaaaacgtcttttactgaaattgccacaaaaatattagagagaatggtattcattaatatgttcagaaagtttattttccgctgattcagaagattttcgttcattttctctatttcagcatctttcaaagcatattgggcaatatctgtctccaagactcttattcgatttatcaactcttccctggaaaggttttcgtatgtatccatataatataattcaaggtttgtataagattcacaccagtgtgtatcctgatggcaaatgtaattataatttctaatgaacgttgataaataagcatttaaataatcggtttttataattttgatataaaatgcagctataatccaaaataaaagatacatttgcagtctaatttcatgaattaaacacaatataatacgaaaaagctatgatgtattggcagaaagatattgagactatgagtcgtgaagaactgaataaattccagttggagcgattaaaaaagacaatagaattagccggacactccccattctacagcaaagtactaaaagataacggtataacagccgacagtatacaatcattggatgatttgcagaaaatcccatttacgacaaaagacgatttacgcagtaattatccatttggcatggcctctattcctattaaggattgcgtgcgggttcactcttccagtgggacaaccggtaatccgacagttgtattacattcagcaaaagacctggaacaatgggccaatcaagtagcccgttgtatgtatatggtcggtttacgtgacaccgatgtattccagaatacatcaggttatggcatgtttaccggtggtttgggtttccagtacggggcagaaaagctaggagccttaacagttccggcagctgccgggaataccaaacgccagatcaagtttattacagactttggaacaacctgcctgcatatcatcccgagttatgcaacccgtttggcagaagtgatgtatgaaataggaatagatccgcgaaaagatactaaattgcatacggtttgtatcggggccgaacctcattcggaagaacaacgtaaacgtatcgagcagttactgggagtaaaagcttacaactgtttcggtatgtcggaaatgaatgggcccggcgtagcctttgaatgtacggaacaaaacggtctgcatatctgggaagattatacgattgtagagatagttgatccgcaaacattacaacctgttccggatggagagatcggtgaattggtcctgactactattaaccgggaagctatgccgcttctacgttatcgtacccgcgacttgacctgcattattcctggcgaatgcccttgtgggagaactcataaacgtcttgctcgcttcaaaggtcgtagcgacgatatgattatcctgaaaggtgtgaacctgttccccatccagatcgaaaagattttgatgcagttcaaagaattaggcagcaattatctgatcactatcgagacggtaaacaatagtgatgaaatgttgatcgaggtagaattaagtgatctgtttacagacgattacagcgtactgcaacgtctggctaaagatatcacaagacaattgaaagacgagttattgcttactccccgcttaaaactggtagccaaaggttcactgcctgtgcaggaaggtaaagctgtaagagtaaaagacttacgcagattttcttaaatgattgttcaataaataaaaacatacagctatgacagtaaatcaaatttctattttcctggaaaataagtacggaaagctaagtgaaatcctggctctgcttgctgaagaaaaaatacggatcattgccgcaacaatcgcagacacctctgaatatggtattttgcgtatcattgtaagtgatcctcaaaaagcatataagatattgaaaagcaacaatgtgagtgccaaccttacagaggttttggctattgttacgaactcctgtgccggaagttttgccgaaacactaaagcattttacaaaagcaggcttaacaatcgaatatatgtattgcttctctatgaatgaaaaatcgattctgatcctccgtactaacaaccgggaagttgcccgggaagtgattcgccgtcagaatctggaatacatatgcgaaagcgacttaatgaaattataaaaaacaaataacaaatgttcggaatagatgatcccggtatctggttagcctacttgttagcctttgcatgtttaattttttctttatggttcggtattgccaattggaataaaggagataaagagagtgataaccctaaacaacccgataaatgaatacgcttacccttggaattgtcgttatagtttacatgtttgttatcgcctggttagggtatatcggatataaacagacaaaaaatgccagtgattatttattagggggacgaaaggtaaaccccattatcatggctctgtcttacggagcaacatttatttcagcttcagccattgttggctttggcggagtggctgcaacatttggtatgggtatccaatggctatgtctgctgaacatgtttatgggagttgttgttgcatttatctttttcggaagacgaacccgtaaattaggagaagaacataatgcacgcacctttccccagttattgggattacattataattcacgcagtatacaaatatttatagctgcgatcatcttcatcggtatgcctttatatgcagccgtggtaatgaaaggcggtgctgtatttatcgaacagatgtttcatatcgatttgcatctggcattattgatctttaccttgattgttgcagcttatgtaattaccggagggattaaaggcgttttgtatacagatgctttacaagctgtgattatgttcgtatgcatgctgttcctgctcgtttggttctatcatataatggatatgggatttgtggaagcgaaccagaagctatccgaaatctccccattggttcccgatcgctttaaggaactgggacatcagggatggactgacatgccggtgacaggttctccacaatggtatacgttggttacttcattgattatgggtgtcggcataggatgcctggcccaacctcagttggtcgtacgatttatgatggtggaaagtaccaagcaattgaatcgtggtgtattaatcggttgtgtattcctgattgttacggtaggagctatttatcacgtaggcgctttgtcaaatctgttttttcttaagacagaaggtgttgtagcttcagaagccgtaaaagacatggataagattataccactgtttatcaatcgtgccatgccagaatggtttggtgctgtcttcatgttgtgcatcttatcagccagtatgtctacgttgagtgcacaattccatacaatgggagccgcattcggtgctgatgcttttcctaatttaggacgtaataaaaataataactcaactatgggggtccgtattggtgttttatgctccattcttgttagttatattatctgttacacattgagtgccggaattattgcacgtggaacagctttgtttatggggatatgtgcagctacattcctacctacttacttttgttctttatattggaaaaaagcaacaaaggaaggtgctttagccagtttatggaccggagcattagccagtttggttgccatgttgttttttcataaagcggaagcaagtgctgtcggtctgtgtaagacattgacagggaaggatgtattaatcgatgtatatccttggtttgccatagatcctatattatttgcactcccattatccattatcgcgattattgtagtgagtctgttgacacaaaagaaatcagataacatataatttgaactatgttagtttttcttatatgctagaaaacataaattagcattttagctattgctatttatagaaaaaccacgatatttgcatcgtggttttttcataatagtattagatttaaggttaacaaagttggttagggcttgtcgtgagacaggctttaattgtttatagccctctccttttccggtaaaattcctacctttgcaagaaaaaagatgatcaaatacttttgtttactccttctgattttatgcagttgcaataataaacccaaagagagtgatactattcatgtatctgttcttagaggtccttctgttattgcatttgctaaaataatcgaggatagtccgaaaatagaaggaaagcgattatctgtcgatattgttgactcaccggaacaaatgcaggccctcttgataaaaggggaagcagaaatagccgcacttcctatgatcaatgccgcgaacttatataataaaggcctgaaatactccttactaggttgtccggtttggggaaatctttatatcgtcggtaaaaaaggagatcatgttcaaacatctgaaagaaaaacattacatattttcggagccggcactactcctgacatcttaacccgctactatttgaaacagaaaggtctatcctgccctttgaattacgcttttactaccccccttgaaataacccagggattgcttagtaatcaaatccggagggctgtattggctgaaccattcttaagtattgcattgaaaaaagacagtaccatatatattgaatcaaacctgaataacccggacagtacctcacctggatttgcccagaccgctatcgtttatgctccttcgttaagtgataaaagaacagtattggacagtttattgaataaatcctgtcaattcgctatatatcagccggaggaagccatacgtatccttgaaagccggaaaatatttactcccggtgcattgactccggaaagtattgaacgatgccgcattaaatatttatcaataggagaagcaaaagaaagtattcttgatttcctgcgtttgataaaagaatatgaacccaaagccataggaggaaaacttccggatgacgcttttttatcaggtaagcaatgaaaaaagggataatatcatttatatcagtttgcattttactctttttctggcaactgactgcatcttatatcaatcagccggaactgataccttccgtccctgatcttttaaaaacattactccagttattcggtagcgagacattttatcaacacatatgtgcaacggtattccgtggtatatcaggaatactcctgtcattggttatcgctttattatcagcttttttgtttgcacgctacgaattgctctatgaactattcaggccgttattaacaattatgagatctattccggttatctcctttattttgctggctttgatatttctgaatccggaaagtattccattaatgattgcttttttgactatgtttcctctgttgacagaaaatctgacaaaaggtatcttgaatcttcgtccgggtctttccctgatggctgatcaatttaaagtcaacaaaagaaataagttgatgcaggttatttatcctcaattaaagccttttctttttagtggactggcatctgcggtagggttcggttggcgggcaattataatgggagaagtgctttcacaatgtactttggggatcggaggtgagatgaaacgggctcaaaatttcattgctgtcccggaattgattgcatggaccatcattgcgattctgattagttttctgtttgataaaggaatcagtaaaatggcttcagtaaaatggaatatactatacaacaatacaagtcatgatgtaaaaagcaaacttccctctcctatagagataacagatatgacctttcaatatgccggaacaaaggtcttatccagtttctcttatactttcgaacctgatattatttatggtataaaggctccttcgggaacaggaaaaacaacattgctgaatttaattaacggttcattgaaacccacaaacggaataattgatcttaaggatcaaaatctctccaatgtgtttcaggaaccggaattactatctcatctgactatattacaaaatgtatctcttcctttgtcctctgtttataacaaaaacgcatctgaagcaaaagcaatggaaatgttgcaattagttgaaatggatatgctagccgaacgatatccgaatgaacttagttacggacaacaacagcgtgtcgctttagcacgcgcactggctttcccttctacgattatgcttctggacgagcctttcaaaggattggataaaacattgaccttccgcattatcgggcggatactctcacgacaagcaacaaccagacaaataattattttcacgtctcataatccggaggagttgactcttttggcctcagtaataattcagttgcccatgatcaattaatcttcacaggattacaagggatcgtaaaccagaaagtagagccggaaccttcttctgattccaccccgatttcaccatttaacatagttataatcgttttgcagatcgacagcccaaggccggttccctgtttaaatttatccagtttcacgaaccggtcgaaaatagaggtttgatcctttttactgattcctgtaccggtatcggttacataaacataaataccatttttcgttagtttatacccaaaccggatagaaccggatgaagtaaacttgatggcgttggataaaaaattagtcaatacctgggtaagccttgttttctcagaaatgatgcaatagtcgttgccatcattttcaaaaatcactttcactccggattcagctcttagtgtaaatgcatgttcttgcggtttgaacaggtcattcaagctaaagttagtatatataaactccagtttgcccgattctattttggaaatatcgagaatatcattaatcagttgtaacagaaaatcattactggattcaataatcttaagatattcctgtttttcttcctggctgtccacctgtgccattaatgtagaaaagccaacaatagcattcaacggagtacggatttcatgactcatattggcaataaaagccgatttcattcggtcactttcttctgccagacgtttagcctgtacatctgcctcatgccgcttatctaccgttatgtctcttaaaatgccgatagccttcaatggtttgccgtcatccccatattcataaacttcaccaatcttttcgagccaaacatattcatcagagaaatatttacaacgaaaacttagtttcagcgagtctatttctccacgggcaaaagcattgactatatcccggtacatctgttgatcggccggatgtatcttttccgtaaaactttcatgagaaatataggaatgaaccatctctccgtcttttaccagggataattcagccgtttcattcaccacatcccatatccacgggtatatgcgtccggccatacaggaaagagccagtctcttattgttttcatgtaattcatcttctattctgcgttgtttggttatatcccacgacatccccagcagataaggagctttcccttcccggggaacaagcagtttcatcgtatccatcgaacgaagttctcccctcggatcgagcatttgttcaacataacgttgcattttaccggaacgaagcactttctcatccatgtcacgaaaactttgtgccgcaaccggatcaataaacaaatcaaagtctgtctttcccacaacatcgttatgaaaacggccgtaaatctgattcatcattgggctggaatatacatagcgaaagtcatcccccgtatcttttacaaaaaaatacatgggtaccgcatttactatattcgacaacaatccggatagatctttatatttttgttccaatgcatcggcatctgaatcaacaggtatcatacagctttaggacttaatgtttatatacccacaaaagtcttgaaaataagcgagagtaacaaataataaaagaaagaattcaaagaggaaagtaaaataataggtaaaagattatctttgtaggcattaaacagagagaatataaatatgacaacatcatttcatacaatcatctcccattctttaaatattccggccggacaagtggaacggacgatcggattgctgggagaaggggcaacaattccttttatcagccgctaccggaaagaagtgaccggaggactggatgaagttcagatcggcaatatcaaagacttgctggataaattaaccgagctgaaaaagagaaaagaaagtattttatcctctatcgaagaacaagggaaactgactcccgaattaaagaaacgtatcgaagagtcgtgggatagtacagaaatagaagacatctatcttccatataaaccaaagcgggtaacaaaagcagaaatagcccgtaaaaaagggttagagccacttgcaaagatcatcatgatacaaaacgaacatgatctgttaggccgggtgaaaagctttatcaaaggagaagtaaaaaatgcagcagaagccctgcaaggtgcacgtgacatcattgccgagtgggtgaatgaaaatgaaggagctcgtaatgctgtacgcaattcttttgcccacacaggcgttatctccgcaaaagtaattaaagggaaagaggaagaaggtgctaaataccgtgactattttgatttcagcgaaccgttgaaccgatgcagttcccaccgcctgctggctctccgtcgcggagaagcagaaggtatcctcagagtcagtatatcccctgatacagatacgaccctcgatcgtctgaaaagacgttttgtaaaagggaatagtgaagtttccgaccaggttgccaacgctgtcgacgattctttcaagcgattgctcaagccttccatcgaaacggaatatgcaaacctcagtaaagccaaagcggatgaagaagcaatccgcgtatttgcggagaacctgcgacaacttctactggctccgccattggggcaaaaacgtgtactgggagtcgatccgggatatcggaccggttgcaagcttgtttgtctagatgcacaaggaaacctgcttcataatgaagcaatctatccccatccgccgcagaacgagaaaagcaaagcggctgccaaggtttcccagttggtatcgacttatgcaatcgatgccattgcgataggtaacggaacggccagtcgtgaaacggaacagttcattaccaatatccgctatgacaggaaggtacaggtattcgttgtcagcgagaacggagcgtctatctattctgcgtctaaaattgcacgggatgaatttcctgaatatgatgtaacagtacgtggtgccgtaagtatcggacgccggttgatggacccgctagccgaactggttaaaatcgatccgaaaagcattggagtcggccagtaccaacatgatgtcgagcaaggggctttaaagaaaagcctggaccagacagtcgaaagttgcgtaaatatggttggagtgaatgtcaatacggccagcaaacatctgctcacttatatttctggtctgggccctaccctggcacaaaatattgtggattaccgtgccgaacacggtcctttccagtcgagacgcgagttaatgaaagtgccccgcatgggagaaaaagcttttgaacaaagtgccggattcttgcgtatccagaacgggaagacgcctttggataattcagccgtccatccggaaagttatccgatcgtagaacagatggcgaaggacttgaaatgcacggtagaagagctgatcaccaataaggagttgaagaaaaagctggatcttaccaaatatatcacagaaaaagtcggtatgccgaccctactcgatattatggaagaactggataaaccgggaagagatcctcgtcaggcgatacaggtcttttctttcgatcctaccgtcaaaacgatagaaaacttaaaagaaggcatggtattgccgggaatcgtaacgaatattacgaacttcggatgttttgtcgacgtcggtatcaaggagaacggactggttcatatttcagaactggccgatcgtttcatcagcgatccgacacaggttgtgtccatacaccagcacgtcaaggtgaaagttatgagtgtagacctggcccgtaagcgggttcaactatctatgaaagggttatgatatgaaaattaataagacaaatgtagccaggctgttggataaagctaaaatagtttatcagctggtgccttacgaagtggatgaaaacgatttaagcgccacccatgttgcagagcaactaggagaaaatgtagaacaggtattcaaaacgttgatcttgcatggcgacaaaagcggatatttcgtttgcgtcattcccggagcggatgaagtggatttaaagaaagctgccaaagtgtcgggaaacaaaaaatgcgaaatgatccccgttaaagagttgttgcctttgaccggttacatccggggaggatgttctcctatcgggatgaagaaacattttcccacttatatccatctcagtgcggagaatttcgaaaatatctatgtcagtgccggacaacgcggtttgcaggttttactggctccggccgaccttattcgcgaaacgaatgcttcgctggccgatctggtaagcggcgactagctgcacaaactcattttgaccgaaaaaacgatagaatcacctgacaatatcgttttttcgatcaaaaagtattttcagaactttctgaaagtatatcttttcccttcgctattaaggatcaaatgttttctgttggattcttcgatggtgaatgtgcgtattttcgatttccaatccgtataaggtaaaaacctctcagcctgacgaggaacatccgataattcgagtgtcagttgattatcttctcccaaagtattaaaaccatgttgtaacacatacatatttgaatccggtataaacacctgatacataaacagcacattctggaaattataaaacactgtatcagcctgtatcacttctccgtcagcttccacctgctgtaactgccatttgccttccagcttatgttcgatatcatcattacatgctgccattatgattgcgacagcggctattaaccagtatttcatatcacttttttataagacgccctttgtgctgggcaattcatatttataaatatcacggcgtatcgccatttttacagatcgtgccaaagctttgaagattccttctatcttatgatgttcgtttgctccctccgctttaacgttcagattcatgcgcgctgcatcactcagacttttaaagaaatggaggaacatttcagtaggcatatcacctaccttttcacgacgaaattcggcgtcccaaaccaaccagggacgtcctccgaagtcgagagccacactacacaggcaatcgtccatcggaagagaataaccatatcgctcaatacctcgtttgtcgccaagagccttcaacaaggcttctccgagggctattgcggtatcctctatcgtatgatgttcgtctacatccaaatctccttttacacgtataaccaaatctactccggaatgttttcctatctgatccaacatatggtcaaaaaaacctaatccggtcgagatttcggtttttccgtttccgtctaaattgatttctacatagatatctgtttcttttgttgtacgttgtacgactgcacgacgctcaccggcaaaaagatattccgttactttatcccaatcatcagtgatcaaaaccggtgaaatagcgggatgttcggccagtaacctgtcagcctcttcgtcggcaggacgtaaccagattgctttagaaccaaggttcacggccagttccatatcagtcagacgatcgccgatcacgtaactgttttccaggtcgtattctccactcagatatttccccatcataccggtgcgcggtttacgattgggcgaattatcttccgggaaagaacgatcaatcaggatgtcatcaaagacaatcccctcaccttccagcgctttgagcattttattatgagctggccagaaagtgtcttcagggaaagaatccgtacccaatccatcctgatttgtcaccatgacaaattcaaaatccaactgtttacgtatgaaatataagttacggaacattttggggtagaactccagcttttccagactatccagctgataatctaccggcggctctattaccaacgtcccgtccctatctataaagagggctcttttcatccttatatactttttaatgctttaagtaatgcatcgttttcttcaggtgtaccaacagtaatacgcaggcaaccatgacacaaagttacattatttctgttacgtacaataacgcctttcttaactaatttattatagacagagtcagctttaccaacataaacaagaataaagttggcatcggtcggatacattttatgtacaatgggaagttccggtaacgccgcttgcaaacgaatacgttccgacatgatacgacgtagctgtcctaacatttcgctttcgttattcaagatagccaaagcacgttcctgcgtcagaatattaacattgtacggatacttgatcttattcagaatcgcaacgatctcaggagaagcaaacgccatccccaaacggatacctgcggctccccatgctttggaaagcgtttgcagaacgaccaggttcgggaacttcttcagttcaggaacaaaggatggttccgttgaaaaatcgatataagcctcatccaatacgacaatcccttcaaaattattcaggattttataaatctcatcccggtcaaggctatttcctgtcggattatttggagagcaaaggaaaataattttcacccattcgtccacctctcccagtaatttgtcggcatccaattcaaaatctgccgtcaattcgactcttctgaattccacatcgtttacattagcggccacttcatacattccgtacgaaggagttatgctgactatgcagtctaccgccggttcgcaaaatgcgcgtatcagaagatcgatcggttcatcgcttccatttcccagaaagatcgaattacggtctacatctttcaattcggcaatacggtctttcagttcccattgcaatgggtcgggataacgattataaggttcgttatagggattttcattggcatccagaaaaacagatgcacttccgtgaaactcgtctcttgctgaagaatacggtttcaattcccagatattgggtcttaccaggctttttaaatccatcatattgtattcaatctaatagttactgcattacggtgagcatccagttgttcgtttccggccatgatctgaatggtttcacctaagtttttaataccttcggctgtgatctcctggaaagtaatcttcttgataaagctgtccaggtttacaccgctatatgccttggcatatccgttggtcggtaaagtatgatttgttccggatgcataatcgcctgcactttccggagtataaggacccataaagacactaccggcgttctctacctgtccggcgatatgagtatagtttgctgtttgtataatcaaatgttccggagcatacatgtttgtgaagtcgatcacttcctgttcatccttcaacacgattatgcgactatgatccaatgccttttctgtaatctctttgcgggataatttcgacaattgctcttgaatggcctcgatcacaggaacaacaatctcttcagacgaggtcaccaatatagcctgactgtcagctccatgttccgcctgtgaaaggaaatcggctgcgataaaatcaggattggcagtcttatcggcgattacttctacttcggaagggccggcaggcatatcgatagcgacatctttcaggcttacaagttgtttggctgccgtcacatactgatttccgggaccgaatattttatagacttttggtaccgactctgttccatacgccatagcagcaatagcctgtattccacccgctttgaatatcttgctgacacctgcagtctttgcagcaaacaggatagccggatgtaccttaccttctttatccggaggagtgcacaatacgatctccttacatcctgcgatatgtgccgggactgccagcattaacaccgttgaaaacaaaggagctgtccctcccggaatatacaatccgactttttcgatagcaacagctttctgccaacaagttacacctggtgtcgtttctatcttttgcccggagaaacgttgcgaagcgtgaaatttttcgatgttatctttagccgtacggatagcctgtttcaaatcgtcggaaacgagcccgtaagcctcttgcatttcggcttccgacacctgaagggccgatagttttaccttatcgaacttctcttcatagcgcttaacggccacatcgccttcattacgcacttcattcaaaacggtacggaccgtatcaaacaatgtcgtaacatccaatgccggccgtttgaccagagacgcccagtcttcttttgacggatatttaattacttccatagtttaaagtatcattttttcaatcggaataaccaaaataccttcggcacccaacgatttcagtttgccaatgatttcccaaaaatgtttctcgtcgataacagactgaacagaaacccagtcgccgttagccaacggtgtaactgtcgggcttttcataccgggtaaaacctggataatatcatccaatttatctttgggggcattcagtaagacatattttttaccttcggcgacttgtatagcttcgaaacggaacaataattcgtcgaggattgccagcttttcttcagaaagttcattgtttgcaatcaaaagtgcctcactctgcataacaacttccacttccttcagacgattgctaaccagcgtactaccggaacttacaatatcaaagattgcatctgccagaccgatacccggagctatttctacagaaccgctgatcacatgcaggtcggcctttacgcctttttctttcaggtaggttttcaatatttcaggatatgaagtagcaatcgtttttccttcaaaccattccacccccttataatcttcatctttcggaatagccaaagatacacggcatctactgaatcctaaccgtttaaccaaacgggcttctccccctttttctacatattcgttttcaccgacaatacctacatccgccacaccgttggccacagactgaggaatatcatcatcgcggagaaataaaacttctacaggaaacccttttgccgataaaagcaaaatacgtttgcctctgttcagtttgatacccgcttcttccaataatagcattgtttcgtcgtataaacgacctttcgattgtactgcaattcgtaacatgtttatctttattttaaaattatattctccaaaaacaaataaggcttaccgaatgacggcaagccttattttatttcttatgcgtatctacacacctcacagcccaccgaactattgcccgttgtgatgatggtgatgatgagatactcttgttttcattttttattttattgatgccgcaaagttacaataataattgaaattgcaaataaatctatcaaaagattagcaaataagcttactttttttctacgaggccagttttattccgataattccacatataaccaacatagctgaaaggatacgccatatacctgccgagtctccaaaaaagaaaattcctatcaataaggttcccactgcacctattcccgtccacactacataagcagtgccgatcggaattgtccgttgtgccagatataaaaagtatccacttaatgccatcgaaataacagcaactgaaagataaagaaaacgcgatcccgttgtttgtgccagtttcatacctacaggccagcccatttcaaaaaggcctcccagcaacaaataaatccatcccataatttattcttatttaattctatataaatgatcggcttgttgccgtattttatttgccagcatcggcggataatccggatgagtagcgaagaatgcatcgacttcagctctagcttcgggcgaaatatgcccggatagcaatgcacgcgcccaagctgtcgggaaaaatatatcaccggtacgttgtatttcctgcatttcctccaaagccggacgaatatatgcaatagcttctttttgtcgtaattgattattcaggtttgccaacacgatagaagcccagggttcgacacgacggttctccgctatcaacaaagaggcaaagacactgtcgcgcacctctttgtggggagaaactgatggtgaaataaatgcatattcgcgcttccgatcagggtttgttatacgcgattgctgagtattgacgatattatcagcctgttccggtaaatgaagtgccaacacataagatagactgatataatcattctcacttaaagcacaaccagccggagcttgctcttttttccatatattatataatgtagtaatcgcttccggagatttagccaaagaacgatatgaacggaaagcctgcaggcgatgctgtaggacagaggatgttgttacgatctgccacaaagtcttttctaaagcttccgtctccgccggatacagacgttgacaattcccgatataactcaaagctgcggaaaagagtaatgagttatcttctttcggtaaatagttcaacatcgtttccataaataataccggagtaatagcctggtttaacagattctcatacagagtgatcagtatggaacctctcaacagctcatttttacagccaggcagataagctgcacatgcttgggcatctgtttcattcagatggaaaaaaccatacccttttccatctatattaggaataatgaaaccaccttcttccgggagcatttttagtttctctcggatgaaatttgaatttctctcgagagaaactgaaatttcatccggatccccgtttttgggaacaatcagaaaggacagatcctgcggccagttaaggccacggttaaaaggatctttctgagtcacgatcagactatcgccaacgagcgaagctgtgatttccggcattcctttttcattcacccagatatgactccaggaggccagatcatcatcagtatatttatccagaatactgataagcccgtcccaggtagcattcccataagcgtaagttttcagatactcctgaataccttgacgaaaagcatccttccccattttcttgatcagcatttcaaggactaccggcgacttatcatagataatgttgccataaaccaaacctgcattacgaagattatccaggttttgtttgataggattagctccggcagtacggtcttctgaatatgccggtggaatgtaatcctgcataaagctcagtgcatgattcacattcggatacaaaggtgtcacgatctgtgaagcaaaatagttggcaaaaacctctttcgtccacacatcatcaaaccattgcatggtgacataatcgccaaaccacatgtgagccgtttcgtgggcaatcagtgcgctacggcttaattgctcgttcaacgtcggactttcgttaagaaacattctccgatccgtataaaaggtagctcctgtatgctccatgccgccaaactgaaatccgggaaggatgatcagatcatatttggcaaaaggatacgggacatccgtatattcttccatccaagctaatgcatcgaatacttctgatgcgattgccggacactgggctatctttttcggatcagtttcccggtgatatagagagatatctcttccgtcccgcgtatatgtttcgcgaataaactttccggcagtgaaagcaaacaaataagtgcttaacggctccgtttccttaaaagaaatgatcttacgaccaggagcagacactgtatccgtacgctcgattgccccgtttgccaccgcctgccactcttccggcatttccagtgtcagggtaaacagagacttcatatccggctgatcgaaacagggaaaagcagtccgtgcccggtcaggaaccaataatgtataaaggaactcgtccctcctgttcaaagactggtcggcgggaataaaatcaacggtcactttatttattccgacaacacttctttctgccggtataagaatatgctcattcttgacttcataaggaacaggttgtccattcaacaataccaacgcgacttgcgaagattctccacgaaaatctatgataatcggctgttttttctgtaaggacaattgaatttcggcatttcctttgacaggttcctgtttcgtctccggaatggagaaaaatagattatacttgacctgcccgaaatgctcttttctgaactgtgccagttcacgacttactccggcttcctgcaacgcagcatctctttgttgtgttccacaggctgttaacaagccaatggctgctattccggcaatacggcatatcgtgtgaatgtgttccatatatttttactctctcaaatattcagcgatcgacataaaattacgttccagaatgtacatctgcgacgccataaaagtaaagaattctccccaatcttgtttacgatggaaatcgattccttctttagctatataaatacgggcaacttctttgccagtttcccttacaaaacaaatatcccagatcaaaccttccggaaaatcctgctcaagcgtatccttataccatgaaaggcgctcgaacatttccaaccggagatcttcccttttatgattcacttcaaggattacataagcgcctgtacggtttgcgtcaaacttcagttccactcctttcaccttggtatcatatagtgtccatatcttcttacgtcctctcaggtttggctgaacttcgcaaaaggcggcaaaactttcccagaattccagtttcaggttctttaattcgtctttactatacattattatttataaatatctttctttctcaatctgataatctctccatactcagccagcttcttcatatctatacgcctggaattgcctacaataacataaacaatgggtttcagtcggatattatgacggtagaagcggacaatatctttcatatccatatccgagatgccggtcaatagagcttcattcggatcactttcaaagccattccttttatatcctgccaccttttccgacaactctctgaaggatgggtaatcgttgttcacctgattagtgatcaattgcttgaccgtcgatattctatccggcttctccggcatgtcactgatcagagagctcatcacttccatcgcatccagtgtcttatcgctttgggtagacaacatggtaacaaactcaccggcttttccctccagcttatgaggcggcaataaataacgcccgctaacacggtaggctaacgaacggaattcccttatctcctgaaacatcaacgacgacatatctccaccgaaataaacagagaacaaacgggaggcatgacgcgaccataaatcgtccgtcacctctcctttcgcaaaaccgtacacaatactttgcgacgctgtcggcatatccataaaataaacgacggacttgtcatacacttccggatctcggtaataatcggaatcggcagcaatcgttatctcttttaacggtatagaggcttttaactgctcttccacctgatcggaagataacgttccgcaataatgcaggtcgcactccgtctggcggacgtttgcaaaaatagccaacaagtcttttcctttcagcttctttatctcagaaagagatagtttacggagataacgcgaccgttcaccatacttcactttctcgagtaaagcatttgcaatattatcactggattcgaaaaaagctttttcggttactttcgcatcattaacaacctggcggatctgcttatcgtcggctttaacatgcgtaatgaaatcgccggccaaaagaacggtttctttgaaatgattatcaaagcctgttatacgaataacaaactgcttgtcgtttgcctcgaaagacatggtactgcctaacacctgcaaccgggttctgaaatcctggaacgacaaagagtctgtccctagaaactggagataattagccagatagcttaactgtggctgctccaatgtcccgacctgatagatcaggttaagcgaaaatatatcggtgaccggattagtagtcgtatataaagttgccagcggattaagctttgttatttgtacgtctttctcaaagtcgataaaacgaggttccactgtctgggtcggcatttgttccaattgttttgcatattcggaactggcctccgagttcttcggcacaacaggagtaaaatcgggtttcatcaaattatccttcggatatttgccggtctttttcgtcacacaaagataattctcgctgaaatacttgcgagcaacctgcatgatatcctcctttgtcagagcatcgatctttgtcacttcctgcaaataatcctcccaacttttaccctgcgaataaagggacatcatgatccgggcacgcgaatcgatattttcaaggctggatgcatattgacgtcgctgttcctgcttcaggctattaaatacttcgtcggtgaaatcgccttctttgatccggttgatctcacgccagacaagcttttctgccccactataagtttgaagcatcagtttgggtacaacggcgacagccaatattccggcttcattcatactttcgttcatagccatgcaggccattattttccggtcgaccatcagtttgtcaagaaatccggtaccgttagcattattcagcatattaacggcaatggcgagcgccgcctgatcttcatggttcgccggaacaccacggaaccccaatcccataacttttactaatggaacagggaatttgaccttcatcttttctttccctttgaagggaggtaaagtcacaatatctttccttggagcttctcccggacggatacgcgaaaaagtacgttccagaatgggcaacacagcttccgtatcaaaatcaccgctcagaaccaatgccatattggatgcgacataatattcttcaaagaatttccgcatctccgtcaggcgcggattcttcagattcttcgtgctaccgatgatcggatacgcataaggatgtggagcaaaatatcgggcaagcagacgatccattaccggaccaccgataaaatcgccatacatattcttttcttcataaaccgtttccaactcactttgaaacaaacggaaaactggattcaataaacgttcgctgtttatctccgcccattgggtcatatattgaggagaaaaggtattgaaataaatcgtagcatcgtaggatgtagccgcattcaaccccgaacctccgtatttagagattaaacggttgaattcgttcggtattacataatcggaggattgaatacttaattcgtttatttcctgctgtatgcgggtgcggacttcttcatcttcagtaacagccagttcgtcgtatttcgcagagatagagtcgagcagaattttttcagcttcatagtcgatggttccgattttatcagttcccttaaacatcatatgctcgaaataatgagcgatccctgtatccggacaatcttttgctcccgcttttacaaccacagctccaaacactttcggctggctgtgatcttcgttcagccagacggtcagtccattttccagtttatattcttttacttcaagtgcttttgaattctgagcagccaacagattcgttgtatttgcaaataacatcatcatcaataatgctttcatggatattttaccaccactaattatatatggtttacaaagataccggattcctttctgttatcagggattattaggcttttttattttaattatccgctgacaaaccctgtccgaacgaatctatttactaaattactcaaccaaatgcctagttaaatgttttcaatataaaaaacgatacaaattatggtgaacttaggtagttggatgaacaagttccttattggttggggcgtagatccgaagattgctgatacattcgatgaatttattattgccgtgttattgattgcggtagcaatcggggtcgattatttatgtcaatacatttttgtaggtagtgttagaaaattgtcggagaaaagccattatttctgggatacattgctgatcaagcgtaaagttgtacataacctggtacatgccattcccggtattattgtgtatgcgttgcttccgatggcctttatccggggaaaagaattgctactgatttcacagaaaatctgtgctgtttatatcgtatttgtattactattggccattaacggttttctcctggttatcatggatatctataatcaccgggaagtaaacaagaaccggtcgataaaaggtttcatacaggtcttccaggtgttggctttctttattggtgctattgttattattgcaatcctgatggggaaatcaccggccaccttatttgccgggctgggtgcttcggccgctatcctgatgctggtattcaaggatacgatattagggttcgtagcaggtatacaactttcagccaacgatatgctgcgaccgggcgactggatcacggtaccgggatcgaatgccaacggtgtggtacaggaaattacgctgaacacagtcaagatacagaacttcgataatacaatttccactattccgccttatacgctggtcaataactccttccagaactggcggggaatggtcgaatcaggcggacggcgggttatgaaatcgattttcctcgatctgaatacgattaagttctgcacacctgaaatgctggatactttccgtaaagaaatacccttgctggctgactatcaaccggacgaaggcgtaacaccgaccaattcgcaaatgttccgtgtgtatgtcgaaaagtatctgaccagcctgccggtagtcaatacggatctggacttaatcatcagccagttacaatcgacagaatatggtgtacccattcaaatctacttcttctcccgcaataaagtatggaaagaatacgaacgcattcaatcggatatattcgatcatttctttgcgatggttcccaagttcgaattgaaggtctatcagtattcggattaacattagtaccgggagacttttgatatcaccttttgggaggctctgattttttccatatatttgtattcataactttaaagacatatttatgagtgaattacaacaatggattaacagttatctggttaaatggggtttagtacacgattcggcaaacatatgggataacctgatcgtgctgcttcttgttataatagtaaccgtcgcgatcgattatacttgccgctacctctttctcggattatttaaacgctttgccaaaaggacccggaaccaatgggacgatctgattgtggaacgcaagatcatcaataagctgatgcacctgataccggccattttggtgtatatcatgctaccgcttgcgcttccgagagaagaaatgcccacattgctgggaattcttcaaatgatctgcagtatctatattgtagctgtcatattacgtttcatcaatgcagcattaaatctgctcctcgaaatatacaaccggaaagaagccttcaagaataaaccgttgaaagggtttgtgcagatcattcaggtacttgtgttctttgtcgggtttatcattatcatcagtatcctgatcgggaaatcacccgctacattgtttgccggattgggtgcatccgcagctatccttatgttggtattcaaagacacgatactcggatttgtggccggtatccaactgtcggccaacgacatgctccgtccgggcgactggatcacaatgactaaatacggcgcagacggaactgtgatcgaagtgacactgaactcgatcaaagtacggaatttcgataacacaatcaccatgataccgccttacgctcttgtcagcgactctttccaaaactggcgaggcatgcaggaatcaggcggtcgacgcgttaaacgctcgatcaatatcgacatgaacagtgtacgtttttgtacaccggaaatgcttgccaaattccgcaagatatccttattaaccgaatatatcgacacaaagcaaaaggaactggaaagatataatgaagagcataatatagatgattctatcaaagtgaacggacgccgccaaaccaacctcggtgtttttcgtgcttacctggtgaattacctaaaaagtaatcctgacgtaaacaaggatcttacgtgcatggtacgccaactgcaaccgacagaaaaagggataccgatggagttatatttctttgccgcaacaaccgtttggataccttacgaaggcattcaatccgacgtattcgatcatatcctggctgtgttaccggagttcgggttgcaggttttccaggaggtgtcaggctccgatctgcatcatttaagaatccaagcttcaaactaataaaaaataaatagactgtctttactcctgatattccgcaggcaaaaacactcaggagcagaaacagtagcgtggtcgctttataattatagaaatatttagtttacatcagaactggaaatagataaacggctgcacaccggcactcttgaattgtacgacaacgaaaaccatgacagccagaataaccgcctgcaccaacagtggagaccgggttaccacaccctgcagagcattctctgccgacttaggcataaagtgcaacacataacctattatcatcaatataaaaactcccttataaccggttacaaactgggtaaacacttccggatggaagttcgtacagatttgcgtaagcatctcttttaccgtttgcagtgagtcggcgcggaagaatatccaaccgaaacaaaccagatggaaagtgataaatatacccaacaccctgcgccagggtttcatctccgaacctaattgtttgaaactaccgaatcgccccatgataaacttatggatagccagtgccactccatgtatagcgccccaaatgataaaactcatagaagctccatgccataaaccacccagcaacatcgtaatcaacagatttatatacgtgcgaaccttccctttccggtttcctcccaacgagatatacaaataatccttcaaccaggaagaaagagaaatatgccagcgccgccaaaactctgtaatagtggccgattgatagggcgagtcaaagttcatattgaaacggaatcccagcaataaagcaataccgatcgccatatccgaatatccggagaaatcgcaatagatctgcaatgcgtagccataaacacccaagagattctctactcccgtatagagcaacggggcatcaaatacacgatctacgaaattcatgctgatataatcggaaatcaccgttttcttaaacagaccgcacaataccaaaaacaaaccttctccaaactctgagcgtgtaacaatcggattcttataaatctgtgggataaaatcgcgggcacgaacgatcggaccggccaccaactgcggaaagaacgatacataaaacacataatcgatccaacgggttaatggtgttatctttccacggtatacatcaatgacataactgatcgtttggaaagtgaaaaaagaaataccgacaggcaggaaaatatccatcggctgataagtgacgctttgcatggaagtattcccaaactgataaccgaactcccgtgtaacagtcgcaataatctccaacaggaagttgaagtatttaaaatatcccaacaaaccgagatttatacataaactaactactaccaacaacttacgtttccactgggctgaagtatggaatatcccctgtgcaatacaaaagtcggacgtggcggtaaacaacaacaggaagaaccaaagcccgctactcttataatagaaataaagggagaacagcgttacatatataatacgggccaacaaatgcttcctgagtgacatgtaaatgatcaggaagcctataaataaaaagaagaacagcccgctgctgaacagtatcggtgaaagacggtgataggtaagtatctcgcccagttttgagaaatccagattatcgaacatcgttgcctgtaatatatcggttatatgtttgcatcagggcgcgatacaataaaagtccctgctcctgatagccttctttagtaaaatgaacacggtcgcgccccatcagtccggccttatgccatttggaactcgaagtttttccacctgtggcagcaaataagtcccaacaggcaaggccttcacgacgggctacttctataatagcttttgccgcgcgttctgtattttcattgcgcacataggtacgtttcttgtttacagtcacccgtttatagcattcgggcggcgtagtaagcaggatagccgtatgtggcatctgtttttttaccaaagagataaagtcttcgatctgtccggcgaactcattacgggtaaaacgtctgccgaaagtctcgttcgtccccagcgatataatcaataacgatgggttcaataaagccagctgacggacataattttcgtctgtataattaacaaacatggctccgttcactcctaccgaatgatataatatacccggttggccattggtcagattgaagccataataaacattcttaaaagaagaggcaggcaacagattatccgtcccttgcttccggcgggtactgtgcaactgcaatgtatcagccaggcacgagatacggaatgtatcggccacaacacccggtgcacacgaggccgtgcttagagaagtcctgatcgaatctttcaatttaccggcaggaagcatcggcatagacttttctccccggtaaataacagcctggttaaaagagtatccggccccattgttcggagccatactgatatcgaagttaatagaaggcgatacggactggataccgattccaccgggcccgatcggagccttcctgttattctgtatacaacgtccggcaacccattctttggcaacagatgaaatgaaataatcgtccggttcattggtcttgctcaatttaaaaggagccacccagccacgtcctgcattaccgaactgttgctgtaaaagacgcatcatacgtccgctgtaatgaccggcctgaatatgtgaatcgcccagctgaacgattgtgacgactgtatcttttccggcacgtaatgaatcgagcgcggcaaagaagcccattaaaggagcatattcatttacgctatccgatgcaggcaacaggatagaatcgacagcaacacctatcttataagaggcggaaggcaatgcaacagtgtccggtaaggccagtgtatcctgcaaaaccattcctgtatcccgaacagacgaacgggctggcgaaagattcgtcgcccctatggtgatcgcaatcagcaccattaaaaccgacaggttaattaaccactttgtctgcttcatcataaaattccttttctaacaataatgctttcattaacgccgtagctatttcgcgtcctccacgaaaactgaggtgcgtataatccttgctcgcccagttattttcgacgaagcgtaccatactgttttctccacccattcccccaaacgtgttccagaacgggataccggtcttacgggcaatctgtcgctgtgtatgaagtaaagccaatacggcaggcatggtttcaaatgcgccgtcctcctgatgactgcggtcggaaacaccgagcagcaatatatctgcttccgggaaacaaacctgaacacgccgaacagcctccgtcatacggctgttgtaccatccgtaatgcaggacactgtcgctcactacattcaaaccatattggagaatgatcagatcatacggccgcaccttactcaagctccggcagcgggcactgtccagacgggcaagaattattccggaatttccccgtaaagaataattgtctaccacaatacccgaattatcttccatcgcaacacctaatgcccggaaaccatccgtctctgtaaacgagaacgaagcttcggtaaatgttcctttcttttcgtattgggttatttcagtcgttgccggcaacagttcgctgattgtatccggttcaccgttacaaagcagtttcatacgggttaccgtattttgttcatacaggaatttcagggaagaaacagtctgcaactccggataacggtttgttgtcttaacagaaaccgaagctttttctcccttcggttcaaacatcatacccgaaagcgtataaccatgatcacgatcagtcagcatcgaccaggtatgccatccttccgagcgctgttcgacagtcggacgaaattgcgaagcgactgatgcaatcggtacaaagccgactccacggccaccaaactctttctgcaaagccgaacgcaggtctgcaacaacaatatccccttcgataaacgagtcgccaagaaaggcaacgcgaaccggacgttttagttctttaccctttttgagtgcggcaaagaaacgcttcaacccgatatggccgaccgaataatcttcaatatgcgtaccgagcgaatcggctccctgaacggaatacatcacattgtacaatgaatcgcgcaaagccaatgccgccgaatcgatccccgtagaacggataatcgaatcacgcaaagcaaccgagtctatttgcaacgtatccggctgttcaagctgcttacgcagtgaatccattgatagtgattgcgtctttacccgtaaatccgaaagtaagtcaaccttttttattttctgtccgaacaactggtccggcagataatatagccccagacagatacatagcgtgattaatagcaacgccagcaatctgccgaaattatcatctctattcatttactcattcttacgaaggtgcaaagatagggataaagttgctatttattacttaaaagctccggtatttcagatggttcgctggcaactcgtatgcctgcctcttccatcgcccgtattttttcaacggctgtaccggttcctccggagataattgccccggcatgtcccatttgtttacccggcggggcagattgtccggcaatgaatccaacgacaggcttggtcacatgcttgcgtatatattctgccgccagctcttccgcattaccaccgatctcgccgatcatcacgattgaatgcgtatcaggatcattttcaaacatttccagtaattcacggaagtaaagtcccacaacaggatcaccccccattcctacggctgtagattgtcccattccattggctgtaagatgataaacgacttcataagtgagtgttccgcttctgcttaacacacctgtatgtcctttcataaacacttttccgggaagaatgccgacaaggctctctcccggcgagatcagaccgggacaattcggtccgatcagtttcgctcctttcatctgtacaaaacaataggctctgatcacatctatcgtaggtattccttctgtgatacaaataattaatcctatacccgcatcggcggcctccatgatcgcatcggcagcaaaacgggcgggaacaaatatgatagatgtgttcgcctgtgtttgctgaacggcatcatacatcgtattgaataccggaatatgttctatctcggttccacctttacccggtgaagtacctcctaccacattcgttccgtattctttcattttcagcgcatggaaaaggccgtcgcgtccggtaataccctgcacgatcaagcgggttgatttattaataagtatgctcatgatgattatcctttcttactggttttttgataattctacggccatccgggttgcttcacccattgtttcagccactttaaaacgcgtattgcgcaacaggtcgcgcccttccttttcgttagttccggtcaggcggacaataacgggaatatcattctctatctgttcgaaagctttcagtaaaccgtaagcaacatcatcgcaacgcgttattcccccgaatatattgattaataccacttttacattgggatctttcaacaacaacttcatggcctcaatcactttttccggattagaacttcctccgatatcaaggaaattggccggatcgccaccataaagcttaatcatatccattgtcgccattgccaaaccggcaccgttcaccatacagccgatctcaccgcccatatacacataactgaaaccactttcttttgccctgacttctatcttttcttcctccgttggttcgaaaagagacaatacgccaggttggcgatacaacgcattatcatcgaaagtcatcttggcatcgatggcgatcaagactccttcacgggtcattaccagcgggtttatctccagcagggaagcatctttctcaataaacaaacgatacatattttgtatgatacctgctaattgattcacctgcgacaacttatcgaacaaagtaaaagcataacgccgggccagataatccggaattccgatcatcggatcgatccggaaatgaaagatcttttcaggggcgcgatgagcgacatcttctatatccatgccaccttcggcactcatcatcaggacgaccgagcgggaattacggtcgatcacaaaactgatataatattccagatggatattcacggcttcactgacaatcacccgggtaacgggataatctttgatcgtcatacctagaatgttttctgcatactgaagggcttcttctgcattacctgccagtttcacaccgccggctttgcccctgcctccggtcagtacttgtgccttgatggcaaccttttcttctcccaactggctaaaagcagccacggcttcatccggtgtactacataaaatatgccgttcgaccggtattccataatcagaaaagagttttttcgcctgatattcgtgtatcttcatcgaataataaatttagtggttcctacttttataataaacaatccggctgtccgttagtttaagtaacaaaaaaacttgatacaaatatatgaaaaacttgaatgatagaaaatggaaagtgcttgaaagcacctatcttcaccgtaagccttggttgacagttcgtagcgagcatgtagaacttcccaacggcaaccagataccggaatattatgtttttgaatacccggactggatcaatgtcatagcaattaccaaagagcataaatttgtcttcgtgcggcagtatcgtcatggattaggcgaaacctctttcgaattatgcgcgggagtctgtgaaaaagaagacccttccccactcgtttccgcccaacgtgagctattggaagaaacaggttttggcaacggagaatggactgaatatatgacagtttccgccaatccgggaacacataccaatctgactcactgctttctggctaccgatgtcgaacaagtcaccacccagcacctggaggatacggaagacctgaccgtccatatccttacgctcgacgaagtaaaggagctactggaaacagatcagatcaaacaggccatacacgctgccccgctttggaaatactttgcggagaaccgtttgatataatcgaaaaggggctacttccctgttataatcacgattttattaggataattcatcctcttttcatatatttgttagggaagaatatgaggaggatgagttatgagtaacatttcagactatatcgaacaatttgtcctggataaactgaaagagtttaacgaaggaagaaatgctgacaaaggcgtgtactatattcttttgcctaatgaaaagaccgcttattatacgctttggttctataatccgggtgctgaatatcatccgaatgttttcctttctacattggaggtcaatgcgatcaactcagtagaaaaagcgatgaaggccgtagccaactccttcgccaggctgaacattactccccgtatcgactccatatcccacaatgccgacgacgttatcactttcggcaaatatcgcggataccgtttatatcagatcgtaacgatcgaccctaagtatgtggcatggattgccaataaatatgacgcgcgtgtacaaagcgaaagacgttttaaggaactggcggcaacctatgcatgggttcatcaggatctatatacttcccgtatgcacaaagtacccgttagtcgatttgtcggagtaatagacgaaaaacttagtgagctgcatctttccatcctgcgggtcaaagtggaagataatccatataagacccgtactatccggggaaccccccatttttacgtcgaccagaaaatcgttgcttcggacgaagcaggcaacctgtttttcttcaccattcgtgcaaccgaccgcagcttggaaagcggtaagttaagtaataccgaccatgcttatcaggccggagagaaaatgcatatccgctcggctaaggtgatcaaacattatacctcctggaatatacggtatacaaaattagggtatataaaactgcactgacgttaaagaaggcctgttacataatttatttcaaagaaatatttagttatctccttttagttacaaggaattcattacatttgcagtataacttaaaaagaataaccaaccatgacaaaaaaagaatatccattaccggaagaaacttcacaaagcgtaaatgagcctcaggctgcatacggattcaatacagagatccaacgtccaccctgtcaatatactattgaagaactgaataaacgactggatcaggctgaagaagaagctcgtcaaggtttaggattgactacagaggaactccgtaaaaaatataatcgatggaatatatcgtaaaatggatgcccattgcacaactcgatctggaggatatctaccaattctatctatccaaaagcgagcaagtggccaatgatatatggaatcgtctattagagtcctccaatcctcttaagatatttgcatatgcaggaccggtagaaccttttttagccaatagagaaaaagaatatcattcgctggtcgttgagaaacacttcaaacttatatattatatagaaggaaacaatgtatgtatcacagcggtttgggatatacgaagggatcctgaatatctaaaatattccatcaagtaagttctactcttttctttctaatatagatcatccctcctataaagaagcaaagcccagctacggttaagatcagaatacggtagttactggtgtgacgtacttcctgtttttgtatttcttccactgttctcgcggtataggattgttgcgtagcagagacagaggtcaggctgtcgatactgctgctaacctgttgcaggcgggctacggtaaggctttgcaggggttgcctgcccgaactgtctggtggaaggaaaatgacctgctttagttcccacgataaggagtcgttcaggatagagcgactttgtaataacaagctgtcgttgcggtctattctgaccgactcgttccgatttgcattttcctgccggcgcacagtttttttcataccacagctaaagaataaacaggcaatacagagcatataaacaagtacttgcatccggttctttccgaattgcttcaacgaaagatgcaggaaacggcggcgtttgtataagatagcctggtcgaaaggtaagcccgatcgcatcaacagttccagcaacttctccgggccttcgggagtataacaatcggctgcctcccccttcacatgctggctcgtagccacaccgcccaccagacggttcacctctttattccggtaaccgctcagaatggcgatcggcttcttatacaattgccgcaacggttccagcaaacaaccgaccagatgctgcaacgatgctcttacctgagcaggcggttcattggctatcgcattctctactgcggtacggctatacgtaagctcttccaatgtgaaatgttcacttaacccggtctttttacttctactttccattgtcattgattttaaatttataggtataatccaccccgaaaagggcacccgcaaacgtactgatctcaccgaaagccaccaatacgctgttatcgatcaatccctgcggatcgatccagaatccgctgaagagaagaacaatcccgctcaatgtgagcaggattgcaataatcaactgaaccgttaaccgtttcataatctccgtcttttaactgtcaactgtcaactcactcgatcaccggtctgtcgtcttcaccaccaccttcgccttcgtcttttttctccaacgacatcttttcgaaactcgtacggcttttagcgacacgcaactctttgcccgggaagaaacgaactttcggttcgcggatcatactcgtagtaaaactcttttcatctgtcacgccctccgaaccgaagttataccggaaatgaccgagatccccgaaatgtacccttcgtccatgctgcaaatggcgaaccaggataaccaccgaacggtcaatcaccgcttttaccccggcactgcctacacccgaactatcggctatttcctcaataaactcttcaaaaggaacataatcgccacacaccatctgtgcatagattttctccggtacttcttccttgtccggccccatgttctttcttgttaccaacttaaacttcattgccataattaataatgtattagttaatacccgttatcgaaacacaaaacaaatataggataagcgaagtaggagctctctgcgataataaggggagagaagagggtctcaagcacgacaacgagacattcatcctctctatcaccgaacctgttctccccccgggttttatacttatttcacacgcggtccgatatacccaggttcattggtgacgggggtcttgtctttcagcatattgagatcggtggctgtgagaattatcgaacgcaatttgtctccgaaatactcgatgtcgtaatcataggtgaaggatagacgaagcgagaaagccagatggacaaaggaagcctcatgcccgaatgccctcccttccgtcaggccgataaaacgctggatgatgtcaggctcctgcaggtcgaaccgcagctcccccagcgcggtatgctccagcaggtaatcgaccgaccgctgccagtcgcgtgtgataaaattcgtaaggaacgttttgtaatctaccgtcaggtaatcccattcgcaaagagctactttataagccagctgccggtagtacaaacgcctgacagggggtaattcactcaggatgatttcaaacttacttaccgacggcttctttctgccgaacaacgatttcaatgtatcgtacataatataaaaaattagccggaaagagtgaattctctttccggccaacaagcatgtacaacgaaaccgagacgattttacgcttacatgccggacaatgccatcattttcaatgccaccgataagttctcccttgccagacggggattctggggcattgctttgcggaagtatccgcaagcagcctccccgtcaccctccatcaatagtaagacaccccggttgatatacgaacggggatcgtcgtcgcaccgttgcaggaaatagcgggccgcctccttatccccgagcgccagcgaggccgccgaagcattcaattgtgctactccgcaagcgggaaagcgataagctgcgagctcatatatctcgcgatactgctccgttcccggacggtacagcgaagccacctgcaagaactctgcgagcgacatcttttccggtgacgaatacacccggtcgactaatacatccatatcggccgtcttcttttcttcactctccacctccccgcttatttccagttcaatgcgtcgcagacgggcaaaaaaggttctctccaactctttatatacggcacccttatccaggcggcgtaattgcctgcgcctggtatcggcatccgggatactgtcgagcaacgccagtacacgggaggcatagctctttaccggagtagtttccagcaggcgggccagcccctgccaatcctcacctacccaatcgatggtgacctggctgttgtcaggcaggtagcgtttatcctgcaggtacttctttaatgccaatacccgtccggcagacagacgttcgttggccgacgtattaccgtcgggcgaagcatagcctgtcagacgaatgttccttacagggtttccgtcccgtaacaggacgtccagctctccgcagagcttctccagttccgcccggttattgccataacgggggtcgacggtggtaccgccggcaggataagcgatataagccgtcagctttcgggtgacggtatggggagcggtaacacagacttcgggagtaacataactcaccatccgcccgtacacagcagccgcatctatctgtatctgcgggatttcggcgtggcgcaccggcgtaatgccccctctattaccgcccgtttccggccggaaagtcccgcaggaaaagagagtagcagccagcgccaacagcccggctgtctctttcactttttcgtagcgtatcatttatccggggccgaattaagggtctgcagcaattgctttcccggtttaaacttcacgctggtacgcggccggatcacacaggtagtacctgcccgggggttacgccccacccgctcggtctgtttccacggagaaaaagtaccgaatccttgcagcataaggggattatcacctctgatcgcatctgccagcactgcttcgaacgtattgataaatttaagcgattgatatcgcggtacgcccatcttaaaggcgacttcgttgattaagtctgttttgttcatgtttgttgttgtttatattgtaacataatctctgttttcctatcgacaagtattcttacttaacattacggacacaactacgatgcacatctctactttctacctcgtgggagcttccacttgcgtattttcgattcacattacaccgtagcttccccagtccccaacaaatgcctacatatagttcctgccacctgtataccgaacacccacgcagcttgcactttcaagctaagcatctgcgctcttcaccgggtaaaataagaccccggcttttgagtgttgtctattgtccgctttcgatacctcgtcaatggttcttgtttcaatcagctcctatatgcttacctgacacggttctctcaccgctgccttttcgctcttccgttcaatacctctatctctactacaatatggtccgaacacaccgacaagcagccttattcgttttagcatcccatttaaaagtgtgtgaactacttgcactagatttatataagatatgagctgtactaccatttgttctgctaccccaaaaaccgctaataggcactccgttataaggagaagttccgttccacattccatacatttcagtatcactaggtaacctccagtcatcaaaatcttctgaaaccaaattagcacaataactattgcaagcattccagttcaaagattgttgtgtacttttattagacctttgaattccactttcgcttccgggaggtggtgacccatattgaaaaatagaaacagcttgcgaataatttttatccggtatattcaccgttatcgaagctaaacgtttgggggttgaagggttcttttccacgcttatcgatagttgagtaggaaatgtaccacttgtcggagtaatcgttataccgtttgtagaatgaactgtaacattccaggtcaaaccttccgtccctgttaaataatagttctcaacccctctcgatgtcaaagcaatagactcgtcaatacctacgtaaacagaagcatcctgactcacacttatagtctgtgaaagtgctccctgaccatcacccacctttacagtgatcgtcccgttacgaacagaatctcctgtattaagaggtgcactataagttatagtttgagtagaccctgttgtattttctgtgccgctcgtactgcctgtcaaagacaaccaattgcccgtagaggttacacctacattccacgacaaacccggcgttgcggtaaaagtagaagtgttatcagtagaagctgtcgctgctaacgtcgtggctccacttacagacaaggttgcacccaactgattcagaacgatatcacctgtcggcccggcagaggtatcccctgcacggacagtgatctttccactacggacagaagaagaagggttaacagctaccgtatagtttattgtctgagacgatccggttgtagacgttcccgttccaccggtatttacagtaatccagtcggccggtgtcgacgcccagggcaaacctttggtggctgtgaatgtggcgtcgccggttgcacctgcagctactatattatttattgtcgaaccgcttgcggttgaagctgcctggttgacggctatctcctgtttcaatccggtataagacgcgtcatctatcgatgcaccggctttcactgttatggttccggtacgcgcgcttgccgttggattgctagccgcctttattttcaaatcctgtgcacttccggtagctgcatcgcccgatgcagccggattagcagtcgtccaatccaaccagtcgcttaatgaagcctgccactttaatcccttagtagccgtaaaagaagaagagccttcggagtcggcggctgccgccagcgatatatcactgcctttcgtcagcgttgaagcgttttgcccgatatgtattgtctttgtcgtaccttggagatcgattacaatgtcagcctccctcacgtccgctgtcgggttgactgcggctgtgaaagggatgctataaggtttgttgtcggagacggtcgaaccgccgccggctgtcttgccacctatcagggcagtcagccagtcgggcattgtgaaactccacagctgaccggggcgcgtggtgatggcaaccgttttttctccgccttcggcaaggatattgtcaggatcgactgtgatcggcggtatcgtacccactgtgatgcgttcgtccaacaggtcgatacctaccagcgtcacgttcgtcgcataatgaccgttgcgcacgatatcataattgttcatatctgcacccggatagaaacggaaggttacatccttatactctacgccgagctgtttggcatcgccggtcaactcgatgcaggtggcattcgtcacacccgctccgatcttctttttattcgagtcgacggtcggcgtacccgtgcccgccatgttctccgccaggtaccaacacatcgttgcacccgatgcgttcgcctcgccggaatagttgttatagcttatatcaggtaactgacgctcagttacctctacccgggatatcccgggtgcattttttaaagcaaccgaagtcggggtgaaagtaaagccgtcgccgcctatcgcatacgtgaacgttatctttgccatcaggcggatcatttccacagggatatcttccactccgccggacacgacctcgccttcccacatacccgccatcttgcaacggttatcgacgggcgcgcccgcaccggtggtacaggtcaacgtcttttctttcaaggtcttttcgtcggctaccgcacccagatcgcccgcgttcgcgataaaatagacatggcttttcacgccggacgcgttcaatggtaattgcaggaggatatcttttgtgtcgctgacggtgccgaaatattcattggacaaacgtttacccgacgtagcttcatactgcccgacccacagggtggcaatcgtgttttcctgctcttccgacagccccgcggcagctttggtacgcaccgagtcgccgacacctgttggcggcgttggcaacgttgtcggtgtatccggcattgccagcgtatccgactcgaacgtgccctcgggcgtgaacgtgatactgcgcgtctgcggcgaatggctggacaagacattcagccggaaaccgacatccacctttgtcccggcgggcagaggaagagactcctcctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggctggacaagacattcagccggaaaccgacatccacctttgtcccggcgggcagaggaagagactcctcctccacatccgtctgcgtgcaaccgccggctagcaccaacagcagacacatacataatcctgttttacttattcgttccatgctattttgttttgttctatttctaaccatgacacacctatttggcccggacacagcggatattttttgacgttttagtatgagctgttgcacccgtttccatatgtactgctacataaccatatgacgccggagtgctggaaatgtacaatgaattggagaacccggtaaaacatggcaccgtctctaactttgctctgtctttttgtactgcaagtaactcttcttgtgatggcaaataccaatcgtcgtgcccctccgctactaaatttttacatgtattaatgcccgtgcctggggtgccactgccattatgggttttacatacctgtatttctcctacataagccggagtatacgcttcttgcgttactgtgaacgtttttgttcgtgccgggctagcgtcggttaccgatacgataaatgtgccagtacgttcggcaccgtagttaacggcaccggtaaacgttaacgtttcgtcgcccgatccgctggttgggcttacgctaatttcattttgcgacgatggactaattgtccatgccaaacctgcagttgcggttatactacccgttgtactactattagcacatgcacttattggagtatccgggttcgttatactaaaagaagatgctgattgcctgagttctactacctttgtcatattacccgcttttacagttacggtagcttttcgttcggatacattcggattcactgatgccgttacatacgtcaacgtctgagcggaaccactagttgttccaccgtcggtagaggcggttccgttcgtgacagttaaccaagaaggaaatgttggtgtgatagtatacgataaaccgcttgttccgttcatcgtaaaagtgccgctggcatcttttgtggctgctaatacgcctgcaggatctatagatgcggtcagcgacgatgcactctgagtgacggcgatcgtttttgttaacccggtatccgtgccgcttacggcattcccgaccttgacggtgatcattccctgacggtcggattcgttcggattgacaacagcatcataagtgatagtctgagcggcaacggtcgtattgtctgttccaccggcactacttgtcagaaccaaccagtcgtctggagaaactatgcccacattccacgacaaacccggcgtagctgtaaaagtagacgtattacccgttgaagctgttgctgttaccgtcttggctccacttacagacaaggttgaagcagactgtttgattattacatcttttgagatgtttccagccttaaccgttacggttgcacttctttcagaactgctgggattaacagaagctgttttataggttaacgtctgattagtaccactagtagttcctccactggtagatgcactaccattagttacatttagccacatagggaaaccggcagtgaaggaatacgacaaaccttgtgttccattcattgtatatgttccactggcaccagctgttacggccagtgctgttgtcggattaacagaagctgttaaggacgatgcactttgagttactgcaatcgtttttgtcaaccctgcatctgtactgctgacggcattacccacttttaccgtaatgttgccactgcgggtcgattcattctgattgacatcaacactaaattttatatcttgggctgcaccggtggtattatcagtaccactgggagtgcttgtcaaagtcagccaatccggactcgatacattccacgacaaacctgccgttgctgtaaaagtagaagtattacccgtagaagctgttgctactaccgtcttggcaccactaacagacaaggttgaagcgttttggccaatatgtattgtctttgtcgtaccttggagatcgattacaatgtcagcctccctcgcctccgctgtcgggttgactgccgcagtgaaagggatggtataaggtttattgtcggagacggtcgaaccgccgccggctgtcttgtcgcctatcagggcagtcagccagtcgggcattgtgaaactccacggctgaccggggcgtgtggtgatggcgactgttttttctccaccttcggcagggatattatccggatcgacctcgatcggaggtatttcacctaccgtgatacgttcatccagaagatctatacccacaagggtgacattcatttcgtaatgagagttacgctcgatatcgtaattgttcatatcccgaccgggatagaaacggaaagtaacatctttatacgccactccgaactgctcggcattaccggtcaactcgatacaggtgccattcgttacacccgttccaatcttcttcttctctaagtcgactgttgccgaactacggcccgccatgttttccgccaggtaccaacacatcgttgcacccgatgtgctcgcctcgccggaataggtgttatagcttatatcaggtaactgattctcagttacctctacccgggatatcccgggtgcattttttaaagcaaccgaagtcggagtgaaagtaaaaccatcaccacctatcgcatacgtgaacgttatctttgccatcaggcggatcatttccacagggataccttccactccgccggacacgacctcgccttcccacaggcccgtcatccggcaacggttatcgacgggcatgcccgcatcggtggtacaggttaacgtcttttctttcaaggtactttcgtcggctaccgcacccagatcgcctgcattcgcgataaaatagacatgactttttacgccggacgtgtttacgatcagcggcaggaggatatctttcgtgtcgctgacagtaccgaaatattcattggacaaacgcgcacctgtcacggcattatactgcccgacccacaggtcgacaatcttgttttcctgctcttccgtcagccccgcggcagctttggtacgcaccgagtcgccgacacctgtcgccggtgttggcaacgttgtcggcgtatccggcattgccagcgtatccgactcgaacgtgccttcgggcgtgaacgtgatactgcgcgtctgcggcgtatggctggacaagacattcagccggaaaccgacatccacctttgtcccggcgggcagaggaagagactcctcctccacatccgtctgcgtgcaaccgccggctagcaccaacagcagacacatacatactcctattttacttattcgttccatgctattttgttttgttctatttctaaccatgacacaccccctgccccctctcgagaggggaaagattactcaattccgccattccgccaacaccaccggtgtacctcccgttatatccggatcggtgggatacggggtgtcgggggctcctacgtttgcgtcggtgaaaacgatgggtttccaggcttgtacggacatatccagggtactcacattatcttttacccgcagggtgaacacgtagcgtttgccttcgtcgaaggtgatgttcttgtcgatcgtcgctttcagggtcgctgtcttgtcgttacgcaccacgtcgatctccacctcgaaaggatcgccgtttttaggaaggaggatacttttcgtcttgttcaggccgatacccttagggtcggagccggcttccaccggaacgaaatcgccgcttgcgaacgtcactgtcgcgtccgtatccgtactcgccgcgcttcccgccgggatctgcgtatcgctcccggcaaccagccccgcacccggcgaggcgagccggcgcaccaccagccgcatgcctttcagggtcgtaaattcgagcacgttgtccgccgccggggcgacattgaataccaccaatgcacatttgcgctggaaagtgccgagtgtcacctcgtacgagtccttcgatatgcttacgttccgtaccgtggaggtcatcacatcctccttatgggggatgccggttatcttatagtttccgtcggcgtcttccaccaaggcccgggccggcgaaaccgcataaaaatcatagataccccctctcaccgtcagctgtcccgcattatccgcaccggtcatcagaccgtttgcgtctacccggcagggcgacaaagcaccgtcggcacccaccacataggtagcttcgaacgaaggcttcgtggtggcgaaggcagcggacaccggcgcctcctctcccagtataccggtgaagtaggcacagatacgcacggtagcccctgcgggaagcgccgccggcgtttcggcgcgggtcaccacctccggcatacccagggtgggccgggcaaagctgaccgtcaccggccggctctcttccggcacgtcctcgtctaccgttcccgtggtacatcccgccaacactcctcctatcagcaaccccaacagatatttacatcccctatcccatctcatatcattctcaattttcaattctcaattgtgaacgggaggggtatcgctccccgcccgcccttttttaaggtctattattattctactaccggcacgtcctcttcacctcctgcggcccagtcggctacttgcacatccgctatcgtgaccccttgcggagacatccggatcgtgtagatataattcttccctttttcccacgtcgtcgttgtcgtagggtccgctcccggcttgatggtaaacagacgcccgtcgtcgagccgcagtttcagcgttacgctggcgtctttcgccggaacgaccagcccgaaagcctgtatcggaaccgtagcgacatcggcctcggcaatgcccgtaccgacggcacgcatagtgccagcctcgaaggtcagcgagtcggctgccgtcgtcccggtcagttcgcccgtttgcaggttcagcgaagcgtttgcctccggggccgtctggaagccgccctctctttccagaatgactttctttacgctccggccggtaaaatagctgccgccgtcggcctctaggatacggaagctgagcttggcaagtgcatggctgaccgtcagatgcacctccgggttccagcggtcgggattctccttcgccgtgccatagaaataatcgtcctggtcggtctgccactgtgcatccgtcgccacatccgccggaggatccgccgagacgaaatcgaaggtctgttcggccagtaccttcactttgcccagcaaggaagccggcggctcgcccgtcgccgttacattcttcgcgttatccgttaccggcgaaaaagcatataccgtcgctttgtcggacgagagaagtaccggtgcatagccgctctcttccccccaggtcttgtcgaccgggtaataactaaacgcttgtgcgggattagtactgtcgtacacgctaccgtcatccatcctcgtcacgaaaagtccgacccgcctgagcgggttcggatttttcgcagtctcttccgggcctccggtcacgacacttctcgattcgacctccaccgataagtccaggctcttgacggacaaagggacatcctcttccgtctgaccggttaccggcagtacgatatccgcctgcgtacaagcagcacacagccataggaaaacggctatcgaaagcagcgaagaggccgaacacccggttatgaattgcctacgcatcatctatcgtgcggtttatagctcgactacgccacctacttctacagactcccagtccgctaccgtcacatccactacattcaagcctctcttcgatacgctgaaagtatagatatagttcttgttcggcaaccagccgccatcgtccggcaccgtcaatacggtggtcagcgggaatgacttcgatgctgcagcacccggttccaggatgtcgaaggttacttttactttattagcctccaatgaagcgatcgggtaaaccaatgtactgatgtaattggcagcatcacggccgtcgccaccgtcgggatacaggaatgtactggcactggctgtctcaccggcagtacccgtctggcgggcacggatcaacaggtatttatccaacgtacgttcgatagctccggctgtcgtggcagcatagtcgatcggatcggcttcgcctgtcacattcaggtccatcgttgtcgctccgattttcagcggtccgtcggaagcatccacgttctcgatcttaaacgatttcacggaacccaatgtagtagccgaattggccgctgtaggtgccgttttaaccaggtccttatcgtacaggcggaaagtaaccatactcaaggcatgtttcatcgtcaacgagatattatttcccggattggcatcggtgttgcttccgtcgggaggtgtcaccgtaccgtctgctgcgggcaatacgccgttgttcaccatacggcccttgccgtctgccggtacaaaatacaaatagtctgtttcttccgccagaatatttacggtgttcttatccgtatttgcagcccaggcagcaccactgaatttctgggccgaattatcggcagctactcccaatttagcagaagtcgtagcaacaatattgatcggataagtaaccttattaccggcgatcgttgctttcgtttttttggctttgtcgtacgggaaataggcaaatacctggcccagattcttatccaggtaaaaagtctttgctttttcagcagaagcatttgccgggaacgtcgtaacgtcgatcgccttccagttttttccgtctttatcgcccataaagcaaatgtcggtagtcggggccgtataggtatagcctatatcgaaaccgggagtttccgctgcataatagcccgatacgtctgcattcgatacaacaagaccgatcgcatggtcggtggtgccataatcggcatccttgaacgtaattgcagtgcccgtcatcgccgctcttgtcttggcacctgtgttcacaccgacatccacacccagcgttacggctttacttgccggaggggttacgatatcgataccgtcttcactctgcgaacagctggctgttcccaataataagatggtcatagccatccctgtcaattctcttttcattttgatttgttttaaatggatttcatcggaaatcctgttgtgtttgtttattctctcttgttaaagcggtatggggtctttgatctctaccgaactccagggttcgaccgagacgccgaccacctccagaccgctgctggtaaatgctatttccacccggtgcgaatagcccggctgcacgcctccggccccgtctgcctccttcaccaccagggtggcggtatgcaggtagccgcccggcttttcgacaccgactccgctcttttgggtggtgacgtgcaacaccagcggatggccggccgtgcccgctccctgtgccgggatcaggatgctgtcctgcaccgcccgggcggccggcagcagcccgtcggatgtgtcatacaggtcgaacgtcctgccggcggccgtgccgatggctcccaacgtcgcgacgccggaagtcgttacagggcttagcgtggggttcgtatccgtcaaacggaaggtttgttgccggtagatgccttccacctctatctgcgtgacggcgccccacaggtccggctggtcgctgaaacagacaaatttcagctgcgtcaacagatgccggaacgtacagcccgtgatctgcgcgtcgggataagacccgttcaacacgccggtagccatcaggtcggtttctccgtcggcgacggtatagaccggtgcgcctcctgccccgccggcccagcccgaacgggggtaatacccgtggagttgcaccgattttccaccctcggggtagaactgcgggacgtcgaacaccaccggggtgctgcccgccccgcctatacggacggcgggcagctcctgccaggcactttcgcccgcgtcgcaccgggcaaaacagacagccagatccgcttcatagccggagttaagcaccgcacgggtggatgcaccgatcgctccctccagctgcaggcgccccgtaaggctgtccggatcgtcgccgtccgaacaggcctgcaaaccggacaggacagccatcaaaaacactatcggatatatcttcttcatctcctactatttaccggaacgtgtctatgatcagctaggtttgataaccgtgctcgtactgctgccgggggtccacggagcgatgtccgcttcgatcacgatctcgccgtctaccgtgaagatcagtgtgatcagatgggcatatccctgacgggcgcctttggaaatgttgttgaccgtgatccttttcgccgagttcagcgtacggggattgtcggggttcgtaccgtcgtagtcggtcattacctccagcgtaagcgcgttggctgccgtacccaggttgtcctccggatagatcatgcaatagccgatctgcgggttctcctctttcgccgtcacgatcttcgacggacagttaaagaaggacaggctttctgtcgaactattggacttcgacaacgaaggagttacaccgggaacaaccttcagttgcaggttgaccgcctgattcgctactttcacggatttgatatttccccatgccttgatcgcctcgtccgatcctacgcatttcacctgcaactgggtcagctgatggcggaacatgaagggcacaaagggattgtccttgtccgccgtctggctctccgtggccatcaggtccatatccccgtcgatcttataagcgatcggagaactgacggatcccccggatgcaggacgcggatagatacccgccattgtcgttttcgtacttgtgtagctgttgtacttcagcgtttcatcgaacgaaacaaactgattgcctgcacccgccatacggacaccgggataccacttactgaacgagctgccgctaccttccagatagccgaacatgacatccagcttctcgtcgtaacccgcattgatcaccgccttggtttcggcatccgccaggccggcgctgatgcggacatccgcagctgccacaggcgtgacttccgtctcgtcattgctacaaccggccatcgacaaggcggccaacaggcccattactacatacttgtttgttttcatacttaaaaaattaatattaataccatgaacagatgctatcggaaaacactccttttaactcgtcaccataccgttgccgccttcgccggtcttccattcgttgacgcttccgacagccataataacgacttcaccacttccctgaaaaaccagattgaccgtgtgcgcatagccttccttcactttcaagggcgttttgccgtcggctgcattataaatggggatcttctggctgtagttgccgtcggcataatacaccttgatcttcagcacatccatcgagccgatcatcagaggttcgccgagggtttccaaagcggtggtcagcacctgctgggaaacacccggtacttcgggtacaagcattttgtcggcgtaggtgatatgcccgtcggcaatcgtcatcgaagccggatactgcccgtcgacgatcgtaatcttcgaaatacttttacccgggttataacgcaaaaattcgtctgtggcctgcacgctgaaagtaagctgcgtcaacttatgaccgaaagtgaaaggagaagaaacgggcgcattcttgctgccggatacgatcccgccgtacatcacatcttccgtacccgttttcttaaatgcgacgatcccgtttgcggaagggatattgggataccaggctgccatatacacatttcccccgttcggatataccttcgagatatccaacggcagccagtcgccggtattctccctgctggctgtcagcgtaagggtgttttgccaggaaggcgtaccggtccatgaaggataattggaactttcgaaagccgtgatagcggctgtaaaccggtcgcccgtcaccaccggcgccttggtaacggctccgttgacagtggctcccacccggatctctgccggctcctgaatgtccggtgttccttcgtcggacgagcaggacgataacagggccgccagaaaagcggcgtacatacatactcttttcatactctgataattaaactattaatactagtgttgcattctatgtctttcattcaatcgatcgtgccgatgccgctgtctccccttttccactccgtcaccgaagccgagagcgaagccgtgccgtcggtacggatacggacggacaacaggtaggaggttcccgccagcgaacggccgtcttcttcatggaagacaaccggcaattgcctgtaataccgccggctgtcgcggctgtccttcaatgcgaccgacaggtgcagggggacgcccggctgcaccatcaccgcctcgggtatctccgtccaggcagtgtcgagcggcagcccgttttccgagcggtctgccgccgcgatacgtacattctccccttcgaacgacagggttttatccgccagcgacaacaccgccgtgcgcggcaggctgtcgaccgccagcgtatgcaatttccagccgtgggcgacgccttcttcgtccatacacagccggaaacggagctgggtaagcagatgggtaaagacaaaggatttcttctgctgccagaacatgtccgtcaggcggccctgctgctcgtcggtcaccaggatgtcctgccgcccgtccatcggataggcgatggtcatgcggtcggtcaatgtcccgtcgggggcaaatccgcgcaggtaaacggggctgttgtccgccggataatatttcggaaaggcgagccccgtacggccgttcactccgatatacgctttccaggtctcccggtattttcccggttcattgcccttggcaaaaaagacggtacccgccgagagcgacgtgtcgcccggtaaataatcgccggaagcatacattaccagctctttccggccatccgacaagccgcctgccccggaagcatcgtcgtccgagcatcctgccgccaacccccagaggctgaacagcaacaggctgtgtactattccgtatgtcaaatccattttcctatacatgattgtttctttattctgtttccaactcagggtgcaacgacttcgccggtccccccctgccagccggtcgtggtaatgaccatgccgtttatctcgtcgtaagcaatctcgaggtcgagcacgatacggacggacagggtcgtttcgaaagccttatcgatcgcttccgttatatccgtggacgaagtaacctccaaaccatcctcgaatttcagggtcagatagaggtcggtgtccttataacgggcttgaccgctcccgggtgcaccgaacaggttcagggaagaagtgtaaactccgggtgagacaggctgcgtgtcaaaaaccatgaaagcaggcgtgtcgaacagaagttcgccggtaggaatatttactccggaggctactccggttaacaggcccgtcagatccgccaccggttccccttccctgcctgtcagtttgatattaagttccagtattcttgtgaggctgacggggtagagttccctgacgacggcgcgaaatccttttaccccgcccaggtcatcccccgtcccgtacaggtaagcgggttgggccacctcgatgtccgccgatttcaaggccgacacctgccgcgccagcccgcacgccttcgcatagcctttatccatatcgagcaatacgctttccgggtcggcggcacataccgccacttcgtaactgcccgcaggcaacgtaccttcataacccgacgatttcccctggcgaatgatgggacggtcggccccgtctttataaaaatagtacgtcatgtcctccggacggtcgttgccctgccagttcaatgtcaggcgtacgagcccgttcttctcccagttctcgtcggtcagacgataggtacagcccaccaacagaaccaaaagcaccccatatccaatccactcccctctcatctcccaattattaattattaattactaattattcattatttaacccgaaaccgataaagcaaactaacattcgccccgaccatcagcccggtcgacgaaaagcgggtttcgagataattcttcacatccatcttgtcataccggtaccgtttgccatcgtagatcgagcggtagcccaccgagaggctcgcctccgtacagaaacccgcacccagcggcaccaggcagcccacagaggcacccagcgagatgaaacgacccgtccggccgtacagattatccaaagacttgtcgatctgtgcgcccctgacatcgaagtcgccgtactggaaaaacacgccggcattcagccaacggtagccacccgccgccaacggccatatcttcggcgtgagggtgagggacgagagcgcccaacggtcgcgcgacttgtctttataggtaaaatcggcatacatcgccgccagccctaccgaccagcgtgtgccgaaataatattcgacctccaggttcggcataaacgagccggtgatgaactccgcatcgcctgtgccgaacaacacagacggcgccacggtagcccagggcaagaggttggtcttgatagccaggccttgctccatcggaggagcagccggcttcgacggccggtgcggcatcgtttttttagcggcgggcttacgaccggacaccggcggggccgttttttcggctaccggctcttctccgaccggctcctctctgacgcccgaagccgctgcacgatgcctgccaggtgcagccggcagcgttgtgacgaccgtagccggttccgcaatggccaaccggtaatcttccagttccgaacggtcgaacagcggatcggtgatcacatatacttcccggttatatcccccgctactgccccgcgaatacaaattgaccaaagggacagccccgtagcggctcagggcggcggttatcgcattcggataacggctctcgctgcaactgatctccagattggcaaaccacggcagcggggcgtgcacctggtaaacatgtacctggtcgcggtagtcgccgctacggtctatataaaaagcaacgcagtcgtgagggatgttcagtttcgatttgagataggcccggatacggctcgcacgcagggaggcttcattgaccaccgcttcgtccgtataattcgtggaaccggcatgggcgacgatcaacaggtgatagtttccgcccagcagtttgacacgggaagccgtcagcgtctcgttcatcgattgaagatagtaagcattatctccatagtcggccagaaaaagatctttctcctcaacgaaagaaaataaaaaagattccgctttcgtgtaagacggactgctctgggcatgtacctctgccatgcacagtccacaaagtacaaacaggctgaatgccgcctttaccatccttctacatatttgctgctttacatcacgcatattctacccactttgattttctttactactgatttttgctacccttatttatataataaggtgaaagcagtaaaaaaacttttttcggagaaggattttagcctttaaaagggctggaaatacaggattgaaatttttttgagactcttttaggaagaaaacaggcagaaataattacacttttttcctaatggatattaaaggaatggcagtccctgccccctttacgtctatacttccttaaattcaagaaatagggcgataaaacaggaagatgtgtgaatatatactaaaatgatatgttttttttaataaaacgacatcgaagccttgtttattcgtagaattctatctatgtttgcacagtcatttatctcaaatgagagattaacggatgtataaacatttggatttgagatagaaagatggcttttcaccttattatataaataagggtatttcttaggcagtcatcactgtttccagttcttcggtaacaacatgaatagcttctgccatcttatccgcatcaaaggctaacagataaatacgggttgtcctttccgacgtatgccccagtgcctggctgataatgcttatcggtaccccacgatggtatgcctccgaagcccacgaatgacggaagacataggtagtcaacacatccaatgaatccaaatcgatacaaagttgcttcagataatggttttccttagccaggcagtatttatactgctcgtgggtcgcattttccggcaagacgggaaaaagatagtgcgcatcggggcagtcgtagcggtctatcaacagccgcatcccctgattgacctccatccggatcaatacgccggtcttctgccggtgatacgccaataccttacccccctcttccaggttctctttcgtcagatggacgatatcgataaacggaataccacaggccagaaatgaaaacagcgccatatcgacagccagctgttttttcggctcctttttcaaatccagcgaagccagctccttgatcacctcagccggtacggcacgtttcttcgtctcctcgcgcctcaaatgaatgccggcgaacggcgagtcggaaggacgccctttccagcccaggcaggcacggttatacatggcacgcaggttgctgagatagctgttcacgctattcacccggagccctttctcacgcagccatttcaaaaaggcgtgtacccgccggggcgtcacatccttcaacgacagtgcctcgctgccattgaacagttcaaagtggttgcgcacggcccggtaaaggtcggccgtactttcatcgcctgcagcgcgtttctcctgctcctgcaagcgcatctgtttgtaaaaatccttatttttcataacttatcccttttttgataaagggcaaagttataacattcagcggtaggcaaaggttagccgcgcagcagaggtggtgatcataacgacaggtaaaggcaacattatattatactgttaccgtgattggcacatcgattaattgttttatctttgtatgcatacataaaatgaacagaagtgatggacagaaaaaaattaccgataggcatcagcgattataagcgggtgatcagcgaagagtattattatgtggataagaccgactttatccgtcagatagtagaagacgggagcctgattaccctgcttccccgtccgcgacgtttcggaaagacactcaacctgtccaccttgcgttactttttcgagaagacggaaggcaatgtgtatcgtccgctgtttaaaggaaaaaatatcgaaggatggaaaggcttcgataagtatcaggggaaatatccggtgatactcctcacgttgaaagattgtaaggcggatacgtttgaagaaacactgattcaaatcggaatacaaatgcaacaagaatttgaacgtcacaggtatttgttagacgaccagctttcggaaatcaaccgggaatggtttgataagatactccggttacagacagacaacattatcctgcaaaactccctgcttttattatcagatttgctgactacccattggggcatgcccccactcgtcttgctcgacgaatacgacacgcccatacatgtggccttcgacaaagggtattacgaccgaatgatcggtttcatgcgaaactttatgagtctggtattcaaagacaatacggatatcttccgcggcgtcatcaccggtatcctccgggtgagcaaggaatcgatattcagcggactgaataatatagatgtagatactattcttgaaaatccgatgtctacctccttcggttttacgcaagaagagacagaccggatgctcgatgactactcattcggaagtcataaagaagaggtgaaggagtggtataacggctatctgtttggcggtaagacaatttataacccgtggtcggtattatcctatattaataaagatggcatactggctccctactgggtaaacaccggttccgacgtcttgttgcgccatctgctggccgacggccccgcacagatacgcgatggcgtggaagccttgatacaaggcgatccggtccgcagtgtgattaatgacaaactggtgttcccggatttactggccaagccggctaatatctggtcgttcatgctctttagtggttacctgaaagcttccgatccggttttgcttccaaataatctgaccgaatacaagctggatgtacccaaccgcgaagtttccaccgtgtttgagactattatccaaagctggatagacggtggcccggtgaaaaacgaccggctcgaacggatgctgcaagcactggatgaaaacaatatgcctatcttccagcgactgttgaacgattttgtagtaaacacgctttcctactatgatacttccggacgagacccggagaaagtctaccaggctttcctgctcggtatgctggtaagttcgggagcttatgaagtaagtagcaatcgcgagtcgggcctgggacgttacgatatcctgatgcgtccgcgtaatattcaaaagcggggtattatcatggaactgaaactttacgatccgatgttcgacaagtcggtagacgatgtgctcgcttccgctcttgggcagatcgaggacaagcaatacgcagccaccctgcatgccgcaggagtcaccgatatactcaaaatggccatcacattcgatggcaaacgggtctggataaagacggctattgattaattattttatctttgtagaaccttttaaaacaggatagtgatggacagaaaaaaattaccgataggcatcagcgattataagctgttgatcagcgaagcgtattattatgtggataaaactgattttatccggcagatagtagaagacggaagcctgatcaacctgcttccgcgtccgcgacgtttcggtaagacgctcaacctttccaccctacgttacttcttcgagaagacggaagacaatgtgtaccgtccgctgtttaaagggaaaaatatcgaaggatggaaaggcttcgataagtatcaggggaaatatccggtgatactcctcacgttgaaagattgtaaagcggatacgtttgaagaagtactggagaaaatagccggcgagctggctactgaattcgagcgccatgattatctgctcgatgtcccggagataaaaccggttcccagagctatttttgaagctgtttatcacggacaagctacacaaaaccagttagaagcggcattgaagattttatcggagctactcacatcttattggggtatgcccccactcgttttgctcgacgaatatgatactccgatccatgtcgctttcgacaaaggatattacgacaagatgatcggtttcatgcgtaactttatgagtgcagtattcaaagataatacgaatatattccgtggcgtgatcaccggtattctccgggtgagcaaggaatccatattcagcggtttgaataatattgccgtattttcattgctggatcgccctatgtgcacggcttttggatttacacaggaagaaacagatatgatactcgacgattattcgttggaaaaacagaaagaggaagtaaagcaatggtataacgggtatctctttgctggtaaaacggtttataatccctggtcagtacttaattatataatgtatgatggcgttcttgccccttactgggtaaacaccggctccgatgtcttactacgtcatttactggccgacggcccttcgcaaatacgtgacggcgtagagggattgatacaaggtaattctattcgtagtgtgataaacgataagctggcgtttccggatttgttgaccgaggcagttaatatctggtcattcatgcttttcagcggatacctcaaagcttccgatcctgttttgcaaccaaataatctgatcgaatacaaactggaggttcctaacctggaagtttcgaccgtgtttagcactattatccgtagttggataaataatggcccggtaaagaacgaccgtctcgaacggatgctacaggcattggatgaaaacaacatacctatctttgaacgattattaaacgactttgtggtcaacacgctttcctactatgatacttccggacgcgacccggagaaagtataccaggcctttttgttgggtatgttggtaagctccggagcttatgaggtaagcagtaaccgggagtcgggcctgggacgctacgatatcctgatgcgtccgcgtaatattcaaaagcggggtattatcatggaactgaaactttacgatccgatgttcgacaagtcggtcgatgatgttctggcatcggctcttcaacagatcgaggagaaacagtatgcagccaccctccatgccgcaggtgttaccgacatccttaaaatggccatcactttcgatggcaaacgtgtctggataaagacggtggaataataagtctcttgccataaatcaagacatttcaatatgccacacttttatggggtatcctgtcatattgatcatattacaattcaatctataacaccctcttttttcaaaagcaggcatccgggcataaatatcctccttccgaccttccaaacctcttactcatcccctgtttccccggtcttatctgtatccacctggcagataattccgatcagccggcaggtagttcgaaccacccggcaggtaactactattcacccggcagacaatcgggatcagccgggagataatttcaacagtctgccgttttatacggaaccagtccgttttttccaacatttttctccggaatgcttctgataatgttcagtattgaagtgacaaagtgtatctgttttccgtatttcgccaacatcacaggaaactacctgccggaccatcccctaatcccgaccaaacggctaccgctttcccctcctctccctcttttctgtcatttctcaacttccggagacttccataaataattatttccttataagagcatgtaaataaagcaaagagaaagagatcgattgacattttgacaaaatgtcgaacttattctttttaactttacaccaatttatctatctttaccgcatataaaaaatcttcttgtatttgtctgatggaaataaacataaataataatcaatatcaaacccagttcgatgagattaagtcgataatcgataatcgccgaaaacgagcttataaagctataaataacgaaatcattcttagtaattgggaaatcggacgatacgtatccgataagattaaatcggccaaatggggtagcaaagttattgatatgttagtcgtatatcttaaacagacaattcccggaataagaggctatgaaaaacgttctattgaaaggatggtacggttctacaacgaatattcatctgtggaatttgcgtcagctattccgacgcaaattaaagagcaagcaattgcgtcagattgtctgacgcaattcgaggaagaacatattgtacttgctttgcttattcagattagttggtcggcacatcttgaaattatgtccggatgtacaacagcggattggttagagagatgaatataaacgtcagttgatacctaaagaggtattgcaagaacatttgcaaaaattattagatacaatagaagaatagatacctgacaaaatatgtttgcaaaaaaaataacactcatactatcaatcttagttgtgctttttatcttcaacgagactctcgttgctcaggagaaagcatttcctaaaaaaggagaaggaattacccttttcctgaaacgtcataaccgtgtaggaaaagagtatcacgacgaatttatcaaattaaacaagacgagactcggcagtggtaattcactcaaaatgggcgttaaataccatttgccgcctttgaagggcgcggcggccacaatagcgaagaaaccgaattacgagcccttatttggcaaggaattagcccaatatcaggtcacctcttccgaattgaaaggttgttgtttttatctggtcagcggacatggcggccccgatcccggagccatcggtaaaatggggaacgtcgaacttcacgaagatgaatatgcctacgatgtcatgttgcgcctggcacgtaatctgctcatgcggggtgccaaagtacatatcatcatccaggatgccagagacggcatccgcaacgaccgtttcctggctaacagcaaacgcgaaacctgtatgggcgacccgatcccgttcaaccaggtgcgacgccttgaacaacggagcgaaaagatcaattcattattcaaaaaggataaagagctttacaaacgcgctatcttcatgcatatcgacagtcgcagtaaaagtcaccagacagatgttttcttctattatcaggataaaaactctgaaagcaaacacctggcaaagaccatgaaatcgactttcgagcataaatataacagacatcaaccgggacgcggatttacaggaacagtaggccagcgcggattgtatgttttgagaaaaacgacacccccttctgtgtttgtggaactgggtaacatacaaaacagtttcgaccagaaacgtttcattctcagcgataaccgccaggcactggcaaactggctatgcgaaggtttcgttacggattacaaacgttacagaaaaaaactcaaataagatcgttgatattgaatttatagagtaaaaattgcagataaatccacggagaaattatacctttgtgtatttataatcgaatcgttttaaaacaccatgaataattcttatatatctccatttgcaaaacccgtttatgtgatgctgaagccggtaggatcagtctgtaatctggcctgtgaatactgctattacctggagaaggggaaactgtatccggaggtaaaaaaccatataatgagcgagcaattgctggagaaattcatcaaagactatctggaatgccaaaccatgccgcaagtactttttacctggcacggtggggaaacattgatgcgtccgatcagtttctataagaaagcgctcgagcttcaaaagaaatatggtcgtggacgacagatcgataattgcatccagacaaacggtaccttgcttacagatgagtggtgtcgcttcttcaaagaaaacaactttctcgtaggcgtctcgatagatggcccgcaggagtttcacgacgaataccgccgtaaccgccaggggcttccctccttcttcaaagtgatgaaagggatcgaactattgaagaaacatcaggttgaatacaacgcaatggctgtggtaaacgattacaacgtcgattatccgctcgaattctataattttttcaaagaactggattgccattttatccaattcgcccctatcgtagaacggttggggacacatgcggacgggacaaaactcacctctccggaacagcaggatgccaatatcgaactggcttctttctccgtcgactccggaaaatggggagatttcctctgtgccattttcgatgaatggctgaaagaagatgtcggcaactattacatccagctgtttgacgcaacattggcaaactgggtaggcgaacaaccgggtatatgtaccctggcacggacatgcggccatgccggtgtgatggaattcaacggtgacttgtatgcctgcgaccacttcgtattccccgaatataagttaggaaatatctatacgcaaactttaacggaaatgatgtacagccagcaccaactgaagtttggggccgacaaatatgataaactccccactcaatgcaaagagtgtgagtttctttttgcttgcaacggcgaatgtcctaaaaaccgcttcctgcatacagccagcggcgaaccgggattaaactatctatgcaaaggatacaagaagttttttaaacatgtagctccttatatggattttatgaaaaaagaattattggcccaacgtccgcccgcaaatgtgatgcaatgggctaaagagaacagagatattttataaaacaacatgaaatacaacagacgtgattttattaaaacaggaggtatggttatgcttggttcgatagcggttccctcttttttagagggttgtgccggaagtactgaagacaaagctgccggtatctcatttgcattaaaccactttggtttaagtgagaatgatatgaagaaggtgctgactgccgcgctggaaaaaggaggagattatgccgaccttttcttcgaacattcttacagaaataatataggattacaagatggtgcggtaaaccgtgcctcttcaaatatagacttcggaatgggcgtacgtgtccttgccggagaccagaccggttatgcctatgtggaaaatatttcattggatgagatgttgaaagctgcccgtacagctgcccgtatcgccgatagcacagcaggaaaagggccggccaaactgactgaagaaccgatcatcaacaacttctacggtgtacaaactccgtgggacgaaatagccgttaaagaaaaaacgccttatctgcaaaagctgaacgatcagatatttgcactcgacaagcgcgtccataaagtaatggcatctttgggtgatacgacttcacacattcttttctgtaatacagaaggacagatgtattatgattaccggccgatggtcacactggctgccgtatgtattatggaagataacggaaagattgagaattcatacgcttcacgtgctttccgcatgggtgccgaattcctgacagacgatattatcagcgaaatagccaaggaagcagtagagaaaacggctattctattccaggccgtaaaacctaaaggaggcgaaatgcctgtcgtaatgggtgccggaggttcaggtatcctgttgcacgaagcgatcggacatgcttttgaagcggacttcaatcgtaagaacacctctatcttctccgaccagttgaacaaaaaggtctgcaacgagcatatcaatgttgtggacgacggaacgatcccattcaaccgtggctctgtcaacatcgacgatgaaggtgtggaaggacaaaagacatatatcgtgaaagaaggtattctgacaagttacctgcacgaccgtatcagcgccaagcattatggcatcccttcaacaggaaacggtcgccgcgagtctttccgccagatgcctattcctcgtatgcgtgccacttatatggaagccggaaacgtaacggaagaagaaatgatctcgaccgtaaagaaaggaatctatgcatccagttttaccaacggacaggtacaaatcggtgccggtgactttactttctttgtaaaagacggttacctgattgaaaacggtaaactgacacaaccgatcaaagatatcaatatcatcggtaacgggccgaaagcactggccgacatcacaatggtcggaaacaattacaaaatggataacggcacgtggacttgcggtaaagacggacaatcctgtccggtaacttgcggtatgccgtccgctctggttagtaaacttacagtaggaggagaaaattgatatgataactaacgaaaataaaaaactggctcaatgggccatggagttcgctctgaagaatggttgccaggcctcacgtgtaagtctgtacaatggttcaagtagttcgtttgaaatacgggatatgaaaatagaccgccttcaacaggcttccgaaaacagtctggtgatccatctgtttgtggatggtcgttacggttcattttccaccaatcgcctggataaacaagaactggaaaagtttatccgcaacggcatcgattcgacccgttatctggccgaagataaagcccgcacattacccgatgcttctctctattataaaggaggaggcgccgacctgcaactgctcgatccgaaattcgacgctatccttcccgacgataaagtggcattggcaatgaacacctgtaatgaaatgatggggaaagacgaccgtatcatttctgctaattcttcttatagcgacgagaaagattttaaatatatggtagccagcaacggtttcgaaggagaagcttgcggctcttctttcagcctggtggccagcgtaagcattcgcggcgaaggcgatgcccgtcccgaatcgtattggtatgattcttcactgtattacgacacaatgacgaaaacaggactgggaacgaaagctctcgaacgtgtattccgtaaactgggacagaagaaagtggcttccggcaaataccagatggttgtcgacaacatgaattccgcccgcctgttatctccgatactcgatgctttatacggttcttccattcagcaaaagaactctttcttactggataaactggatcaaaaggtgctgggtgagaaattgacgttaatagacgaacctcatataactaaagcttccggagcccgttatttcgacggtgaaggtgtagcaaccaagcgtctgccggtatttgagaacggtgtactaaaaacgtattatatcgatacctattccgccaataaaatggatgtgaagcctactatcgcctccccttccattcttacaatgcagatgggcgacaagaatacggagagcctgatcgcttccgtcgataaaggtatcctgataaccggtttcaacggtggtaactgcaacagtacaaccggtgatttctcctatggcattgaaggtttcctgattgaaaaaggaaaactgacccagcctatttcagaaatgaatgcaactggtaatatgatcaccctatggagtaatctggtagaaacaggaaacgatccccgcctactctccagttggcgcattccttcgttattgtttgatggggttgatttcagtggactataacgatttattcatacagattatttatctgcgaaggctggaaactatttccagcctttattttattccaacatttgttttttctaatcggaatctttatatttgccaatacatttaataaaacttataactatgaaacaaaagactattccaccacaggtggttattaatgagaagcttggcgatttctttgtcgatattgcgaagttggtatttgccggggttgtactcagcactttattggacatggaagtagatagacagactgtactatcatctggagttcttacgactattgtattggttacggtaggatttaagttttactcaaagaacaaaaaataaaatggaaataatatatttatttaatggaatgagctttttgggattaattctgattgcttaccttacctatgaggagtggcagtataaaaagaaacatcctaaaaagaagtaataaaacaatataaaaagacaacatgtcaaagttatatgaattttgacatgctgtcttttttattttaccaatagataaaccgaaacaaaatgacagacactgccgcccaacacaaagaaatgccataccgggtgcatatacttatatttatcaaggaaataaaaaatgcatcctactgtatagaacaatcctcctcctatcagccagtataatacatccatcgaaccggtttgccgacacacatccaacaaaggcttgaaggcaatgacaacgacccatcccatggccagataacagacggttttcagatgatccgtcttcttcatcttccggaaactgaggataatacctatgactgccgcaatccagacaatggaaaataacaaccatccccaatagccctcatgacggagggcgatcagggtaaaaggcgtataagttcctgctatatgcagataaatagcactatggtcgaaacgacggagcaaccttttactacgtgcattcgcagatgcatggtaaaaggtcgatgtaacgtaagaagatgtcatgctcagcgcataaaccaacgaactacccacgacccagggatttccattccggatagaagccaccaataacacaatgatagccactattccgaaaatcatccccgccccatgagtcagcacattggctacttcttcaccatacgtttgtctttgttgggtcctgaccatctttggcttacagttgttctgccttgaagccggcttccgttaccgcagaaataacaatatcggccggaacattagctgttacctccaataccttttccggtgatttcaggtcgatagaccattcatcttcctttaccaacttattcagtttcgcaccgatggcagccacacagccaccacattttgcatttgttttaaatttcattgttgccataattcaatatgtttataatattacttcataaattttaatctcaaactgttaagaacgacagacacggagctgaaagccattgcagcacttgccagcatcgggtttaacaacaatccgtttatcgggaacaagacaccggcagccaacggaataccgatcaggttatatatgaatgcccaaaacagattctgatggatcaggcgcacagttcttctggataacttaattgcttcgggcaacagtaacaaatcggatgtgatcaatgtgatcatagctacatccatagcaatatccgttccttttcccatcgcgatactcacatcggcacgagccaacgcctgcgagtcgttaatgccgtctccgaccatcgccactttctttcctaacttctggagagatattatatactcttccttgtcgttcggcatcacttctgccttgaaatattttatgcctaaagaatgagcgactctatctgctgtttttatcccgtccccggtcagcagatgaacttcgatacccattgcggtcagtgccctaactgcagcagccgaagtcggtttaatacggtcggatatagccaatgcagccagcagttcattcccttttccgtaataaacgacactctggccatcttcctgccagtgaagaatctgctccattgtcttttcagggatttcagccccgaacatttcgagtaatccctggcttcccacccaatatgtaatgccttcgacttccatacgtataccgcggcccgtaagactttcaaaaccttcggtttcacaagtggaagcccctgaatcttccagccagcggataatagcagaagccaatggatgttccgactttaattccgccgtatacaaaatatccagataacaaacattcgactctgtcagccaacaggattccgtcacaacaggaactccctctgtcaatgttccggtcttatccaacacgactgtatccactttgcagagattctccaaagcgaacgcatcctttatcaggatatgtctttcagcccctttgcccattcccaccatcaaagcggtaggcgttgccaggcctaaagcacacggacaggcaattaccaggacagagacagccgaaagaagtgcataagagaaataactgctaccgccgatcaccatccaacacacgaacgtgataacagaaaggagtacgacgaccggaacaaatataccacttattttgtcaactatacgctgcaccggggctttactcccctgggctgcctgcaccatctgcacgatttgtgccagtatggtatcattccctacaccggtagcttccatcgtaaaagctcctttctgattgatcgttccggccagtacgcggtcgccggcggatttctctaccgggatcggttcgccgctcagcatactttcatccacagaagatgaaccttgcagcaagagcccgtccaccgggatcttttcaccgggacgcacactcaatacattccctctctgtaaggaagagataggaacttcttcctcttttccgtctataatccggcgagctgtcttaggttgcaaccccatcaatcctttaatggccgaagaagtactgtttttggcccgttcctccattagttttcctaacaggacgaatgctatgatcacaccggaagcctcatagtaaacatgcggctccaatccccgttcataccagaactgaggatatatggtattgaagaaactaaatataaaagcgatagatgtactgagcgcaaccaacgtatccatattggcttttccctggatagcatgacgcacaccgctcacataaaacgatcgcccgaacagcagcataatggccaatgccagcaccatcataatccaattggcatacggcatatgcataaataccattcccaataaagccaaaggaacagataagatccatgcacctattgtattacgtttcagtttcttataatgcttgcgcgacatttcctcctgctcggccagcggatcttccgattcaataattaaatcgtatccggcagcccgtacagcttcctgtatctgttgtaaagtgataacggatggacgaaacctaacagacaaggtattagccgcgaaattgacagttgcttcttctactccgcttagtgctccgacggtactctccacattgttggcacaaaccgcacaactcatctcaagtacaggtaagaccttactttctatctctttcatcatatcttatgttttaattctacctcttaaaagaagaacaaagatacgaataaaacagttgcaacaaagttgcggattttcaaaccagccctttaagatatgtactaaataaatagatttatttggtatatttgtcctattatttaacattcggatatacgatctttgtcaaacataattaacgaatgaattaaaaaacgaatacgtatgatacttgaatccttaaacaacacagaaaaggtagaacgcttgcaccccttattcaaaaaagcattcgattacataaaagctacggatttctcgaagatagaagacggaaagtatgaactggatggagcacgtttgttcgtgaacgttgtaaccctgttcggtaaagacaaaaaagaggctgccatcgaaacacataaaaagtatatcgatatacagcttcctttattaggagtagaaaagatcggatggaaacccggttgcgaattgcaggaagtttctataccttatgatgaagagaaagatattgctttttatgtagaccgtcccacagcctataccaaaatctatcccggacagtttgccgtttattttcctgaagacggccatgcacccggcatcggtgaaggaagtatccgtaaagtgattgtaaaagtacaggtagaagaataatattgccagatacgacaaagccggtattttccgaataaagatcgatctaatctttatggaagataccggcttgcttatttttatcttatcctcctattataacatctattccgtaacgactaaatatatccttacaacgtcgtaccgtttcttccgaaggggtttccatcggataatgatccgggttataaaccgtcccgagtttctcatgtttgttcttacctatattgtgatacaaaagcaggtttaccgtatgatactgccagggcaaagaagctaaaaactccgccgaccgggttatatttttttcgtctgcattcactccttctattaaagggatacggatataaaactcatgaccggcatctgctatcatacgtaagttagacagtattaactcattaggaactccgcagtaaagcttatgtttaatagaatccatgtgctttaagtccactagaaaaagttcggtatgttccatcaccttctgtacaacatccggtttagcatacaatgtcgtatcgacaacacgatgaatacccaactcaccgcaacgatgaagcaattcgagcaacatgtccggatgtaataatggttctcctccacagaaagtaacacccccctccgatcgatccatgaaaaccgtctccttctcgatctccttcatcaggtagtcgatggaatattccgttcccgaaatttccattgccatagccggacaaacttctgcacatttaccgcacagatcacacaaagaggagtcggtaacaaccccatcaggtgtcaaagtcaatgccttttgcggacaatcatccacacaggtacgacatcctatacattttttctttgtatatagcttctgtttccggctggacaatccttccgggttatggcaccacacacacgacaacgggcatcctttcataaagatagtaatacggatacccggcccgtcgtttattgcatagcgcttaatatcgaatatcaaactcacttgtcaactgccaactaattaaaagttatcctgttccgtacgtgcaatcacatcagcctgcaggtcggcattcatatcattaaagtaatcgctgtaaccggctacacgtaccaacaagtcgcgataatcttcagggcatttctgggctgcatataaagtctccgtatctacgatattgaactggatatggtgtccgcccaatgcgaagtaactacggatcagggaggccagtttcgaaatatcttcttcacgcttcaacaggctcggcaggaagcgctggttcaataacgtaccgccgctctttacctgatccagtttacccaatgacttgataacagcagacggtccgtgcgtatcggcaccatgtgaaggtgaagtaccatcggaaatcgctttctcagccaagcgaccgttcggagtggctcccattacttttccaaaatagacgtggcaagttgtcgataacatattcaaatggaaacattctcctttcgtattcggtttgccttcaatagcatcgtacaggtcgttgaacatctgaacagcaattgagtcggcatattcatcatcattaccaaagaacggcgtacggttcaggatcgtctgacgcataacttccgctccgacaaagttgtttgccatcgctttcagcatttcatccatagtgaaacgtttgtcttcaaacacatgtttctttaatgaagaaaggctgtcggtaatcgtacccaggccggtacattggatataagtcgtattataacgcggaccacagttgtaataatcgcgccctttagcaatgcaatcgtcgataaacagcgacaggaaggttgccggagcatacttagcaaacatccggtcgatataattgctcacacgcaccttcatatccacaaaataatgaatctgcttcatgaaagccgcatacagttcatcataacttgcaaaactgcacggatcacctgtttctaatcccactttacggcctgacaccggatcgacaccattatgcagcgtcacttccaaaatcttcggtacattcagataacccgtcaacacataggcttctttaccgaacgcaccgacttcgatacaaccgctgcaaccgccttcacgtgcatcatgcaatgatttaccctggcgcattagttcctggatatagacatcagggttaaacacagaaggataaccatgtccctgacggatcaccttacatccggcacgtaagaaacgttccggcgtacgggcgcttacatgaatggcactacccggctgcaggatatgcagttcttcaatcgtttcaagcatgatataagacacttcgcttacaccatcgctaccgtcagcctttacaccaccgatattcaggttggtaaagtcattgtatgtaccactttccttagcagtaataccaaccttgggaggagccgtatggttatttaccttaataaagaagcatgacatcaattccttcgcttcttcacgggttagcgttccggcagctatttccttttcatagaaaggagccagatgttgatcaaaatggcccgggttcattgcatcccaaccattcaattctgtaatagttcccagatggacaaaccagtacatctggatagcttcccaataagaacgaggggcatgagccggaacccaacggcaaacttcagcgattttacgcagttcggcagcacgcttcggatctttctccgtcatcgacatttcgtcagccaggtcggcatgacgttctgcgaacaggatagccgcatcgcaggagatagacatagcagtcagttcttcctgcttatccgttgcttcgggatcattcataaaatcaagatccgccagctctttggcaatacgttctttcagatccagtaaaccatattgataaacttttccgtcgagagcagtatggcccggagcacgttgctccataaactctgtaaacatacccacttcgtatgcttccttccattctttcggaacatggctgaaaatacgttcacgctgtgtacgtcctttccagtaagggatcacctcacgttcgtaagtatcgatatcttcctggctgatggtgtaacgctgcagttcgcgggtatttaatacatgcaggtcttccacactgtggcaagtcaattccgggaaagtaggaacagctttaggagccggaccacgttcgcccacgatcagttcatccttaccgatatagatagtcttatatttgcatatttccagaaagttcaatgctctcagaataggaataggatatttcccgtaattttctttgtagaaacgagtttcgatcagtgcccgttcgatcgataaagaaggttcagcctcgaaagaaagctgacgtaaccgtttgatacggtcgttcataccataagcatttgcttctactgtgggagcaaagtttgatgcactcagaggtgcacgttgagctgttgttgtactcattttgaatggtttatttattcgtgaacactatacgttaatgcaagaatttgccgcaccgcaggcagcaagacccgggagagaaaggattgtttaaagatagaacattaaacaattgaagagttttctgtagccttttataatcatattatttgcaaagtgttacatgaacaccgcaaacataaaaacttttcatgaataaacaaaataatagcgtctgtattttttagtatatttgcaacattcgttcagatttcatggttattcatataaatatatctacatggaaaatcgttttttaggacttatagagaacagtatcaaggaacattgggatttacctgctttctccgactataatggacatacataccattataaagatgtggcccgtcgtatagaaaaatttcatataattctcgaacacgcaggaataaagaaaggagataaagtggcattggtgggacgtaactcgtccaactgggctatttgttttttcggcatattggcttatggcgctgttgccgtaccgatcctgcatgagtttaagccggataacatccatcatattgtcaatcattccggggcaaaagctgttctggccggagctaacaactgggagaacatgaatgaacagatgatgcccgatgtcaagttgttcatgatgctggataatttctccattatcaaaagtaagaacaaagatgtacgtatcgtacgcgacaggatcaatgaatatttcgggaagaaatatccccgctccttcacgactgcagatgtgaaatatcataccgagcaaccggaagaactggctgtattgaattatacatccggaacgaccagtttttccaaaggggtgatgatcccttttcgcagtctatggagcaatacacagtttgcttatgataacctgccgtttatccatccgggcgatagtgttgtttgtatgcttccaatggcgcacatgtacggtctggctttcgagatactgaattgtgtaaacaaaggatgtcacgtacatttcctgactcgtacccccagccccaagattattgcagaagcttttgcccgcgtcaaaccggctttgatattggctgtgcctcttattattgaaaagatagtcaagaacaagatattccctgaactggaaaagcccctgatcaaattactgctgaaggtaccttacctcgaccagaaggttctcgatacgatcgccaggaaactgaatgattcgttcggaggcaagtttggagaagttgtgatcggtggtgcagcattaaacagagaagtggaagaattcctccgttcgatcaagtttcgctatacggtcggctacggtatgacggaatgcggcccgttagttgcctatgaacaatgggatacattcaaacaaggctcggtcggtcgtatcgtcgaccgtatggaagcccgcatcgattcagctgatccggccaacgaagtcggtgaaatactggttcgcggaatgaatgttatgttgggttattataagaacccggaagcgacgaaagctgttatgatgcctgacggttggatgcgcaccggcgatttgggtacaatcgattccgatggcttcctttatatccgcggtcgcagtaaaacaatgatactcggtccgagcggacagaatatttatccggaagagatcgaagatcgtctgaacaatatgctttatgtcgctgaatcgttgatcatttcgcaaggcggtaaactagtcgccctgatctatcctgattgggagcaggtagacaaagccggcatccagcattccgaaatagagaaactgatgcaacagaacatcgaccagttgaatacagaaatgccgtcatacagtaaagtcacttgcttcaaactctaccaggaagagttcgaaaagactccgaaacgtagtattaaacggtatttataccagccggcagaagatatttaaggatggctgatacctcgtttttcccctacatgataaaacagcattaaaccattcaccattcacccatatgcctttaaaaatcaaagggtgagtataaaaaggtgaaaggtgaagggtatattactcattttaccagtaaaaattcgagttattatacagtttgtatctgcgagatttagcacttaatactcaattcgcgcaacacatcacggatcttttcgaacgtcgtgatacgcgtcggaaccagcggcaaacgcaatttgttttcaatgaatcccattgcattcaacatactctttgctccggcagggttaccgtctacaaatagcagttcgaataattcggtgaagcgatggtgaatggtgcgggcatgatcgtaatctccggccaatgccagacgaaccatccggctgaattcacgtgggaaagcgttaccgataacagagataaccccaatcgcacctaaagtgatcaatgggaaagtgatgccgtcatcaccggaaataacattgaagttagccggtttattcttgataatgtcatccatctgagtaatgttgccggatgcttctttcactgctaccacattcttaaattcgcgggcaatgcggagggtggtcgcagcagtcatattcacacctgttcttcccggtacattatataatacgatcggaagtttggtagcttctgctattgctttgtaatgctgatagataccttcctgggaaggtttattataataaggcacgacagacaggatcgcgtcgataccatcgaaattatcattcttcaatttctctacgatggaacgggtacaattaccaccgacacccaggacaatagggatacgaccattgaccttagttacaacgaggctgattatcttctttttttcatcttcagtgagagttggcgtttccgcagtagttcctaacacgaccaggtaatcggtcccgttctgcacctgatagtctaccagtctgcttaacgcttcataatccacactttcgtcttccttaaagggagtgatcagtgccacacccattccttttaaatttatgtctgccatggggaaaatattccttttttgttatttagcactgcaaaaataacgaatttatatcatttagaacggattgtctgcaaataaaataagatatgtccgaatatatgcttaatatcagcatcttctgtcacagaaatagtgagatcgtacaagtctaattcgctgcttcgtgctccgactttaaatgttccggggtgttgcaacagcagatattgcatcacatagttatcaccccgggtgagatcgataagaatatcggcattgcaggcacaaaatttcttttgtatatcattcttggggatgtaccacatatccagatcggtctttccgtgtatgactgtgtatgccggatccatttcaggaaccgtatcacccgccacataaacacaaacatcgatctgtttatgcaacatacgtaatgtttcaaggcatggctcgacaatatcgcggtcttccgcattgaacaggacaaggatatgacgggcctctttcagcgtacagaaatgactctgacgtttgggagcgccggccagatcttttactttctttcggataaaatggttcgtcagtctcattctgctaacatatttaagaattcgttttcgttgatgatctttacacccagtttggcagctttttccagtttagccggtcccatgttttctccggccaggatataatcagtctttccggaaacggaaccactgttctttccgccatgttgttcgatcatcgctttatattcgtcacgcgaatgctgagtgaatgttccgctgatcacaatagacaatcctttcagtttgtccgaacggtttgccagcacttcttcggctaccgtcatttgcaaaccatattcttccagacgggctaccaatgtacggttttcctcgtcagcgaaataatctaccacactgcgggcgatacgttcccctatttcatctacttccgtaagcgtctccaaagaggcttcttccagctgtttcatggaatggaaagcggatgccagacgcttggctacggtttcaccaacataacggattcccagtccgaagagtacacgttcgaaaggaacctgtttagattcttcgaggctgaccatcaggttacgggcacttttctccgcccagcgttccagacgcagcagatcgggaacctccaaagtgtacaggtcggccacattctttataagaccggcattgaacaagtcttccaccgtttccgggccgatgtttatattcatggcacgccgggtaacgaaatgttcgattcggccttttatctgcggaggacaacccgattcgttcgggcaatagtgggctgcttccccttccggacgataaagcggtgtaccgcattcggggcaagtcttgataaaagtaacctttgctcccaataacatagagcgcgaatctacatccacgccaactattttagggatgatctcccctcctttttctacatagacattatcccccagatgcaaatccagcccttctataatatcggcattatgcaaggaggcacgttttacggttgttccggccagcaataccggttccaggttagccaccggagtaaccgcccctgtacgtccaacctggaaggaaacggagttcaagcgggtaacggcacgttcggcctgaaatttataagcaatagcccaacgcggactcttggctgtaaatcctaagtttttctgctgacggagtgagtttacctttaaaacaatgccatccgtagcaacaggtaagtttttccgttctgcatcccaataagcgatatagtcgaaaatatcctgcaggctgttacatttacggataacatccggtattttaaatccccaggtgcgggcgatctgtaagttttcgtaatgtccgtctgccggaagctgctctcctaacagataatagaagtaagcatccagtttacgggaagccacaatggccggattctgttgtttcaaagttcctgatgcggcattacgcggattggcgaaaagaggttcttcctgttcttccctttgcttattcagacgatcgaactccgcccagggaagcaggatctccccacgtatctcaaagttagccggataattgtcgccacgcaacttcaaaggaacggaacggatcgtttttacatttgccgtgacatcatcgccacgggttccatcgccacgggtaacggcacgtaccagccgaccgttttcgtagatcaacgagatagaagtgccgtcgtatttcagttcggcaacgatttcgaaaggctcgttcaaagcacgttccgtccgctcgtagaaatcacgtatttcttcttctgaataggtatttcctaaagatagcatcgggtattgatgtaccacctgttcgaattctttcgaaaggtcgcttcctacccgttgcgtcggcgaatgcggatcggcaaattcaggattggcctcttccaatgcctgcaactctttcatcttctcatcaaactcacggtctgatatagtcggtgtggaaagcacataataattataattatgttgttccagttcatcacgaagtgctttaatctttgcctccatatttaaaaagttgacagtcgacagttgacggatgacagataaaacagctcggagaactgtcaattgtcacttgtcaactgtcaactgattaatatatcagttttacattatcaatccagaacgtattacccggtgagccgatataggcaccgccatggctggatgtgaattgcagcacgatatgtgtcggcacctctccttcttctgcccagccgatctcctgaatgggaacactttttccctgactgttcagcgtataacgttcttcaacctgtatgcacatataaggtttgtaatcgggatgggaagtaatattgccgtaaaggatcggataagtagcgtcgtttacccaaccgtctgtcgatgatacataacgttgcaccattgttcctacccgtttggcatatacatttccttccttatcttcccaacgtttctgtaagaatagaatagctgcgatcgagtcctgtccggccactttcgacttacggctgaatcctgtactacggatacgttctttctccggcgccgccttgatcttataatcgaaacggatcgcttccggtttcttggtgaaaggaacaccgctccccagcatactttgcgggttctttgtccctttgatcggctcgtgtaccgctcccaggaatacggaaccggcagcaacgacctcgatatcgaccaaacctaatactttcacactttccatacgtgtctccaggcgtgcacaccatccatctcctctcctttccggaaaaacagatgtattggtctttactactccggcaacctttgccatcacgttcgagttagcccacggagaaccaccccggttacgataagcaacattgccgacaattgtatcggtcggtcccaactcatacaggtgtttcttatttccaccaatgattcccgactcctggatttcacgaacaacccactgatccatatcaccgaaagcaaaaggtacgaccttttcctgtccggtcatggaagacagctggctacctgcaaacaaaaataacaatatattctttatataattcataagctttgcttaaaagttgaaagaatattataaagaatacccccactctttgagagccatgccccagttcttttcgacaatctgtacggtacggtcgtcgtatttgtactggttctttttatatccctttttcttacccagatatttctcgatctcggctttagacgattcgaatcccggcaggttcagtttacgatagatgtcttcagtcattgcataagcatcctgttcgaaatcttcaaacttcacttccaccaggtttccttcggggatcagccctttctgttcttcaaatttatagaacaagcggcgatatacttcaataagattactttcaatctgttcattagtgatgtcttgcaaacgaagcggctgtattgtatttgtaaagaaactgcgcgtactttcaaatacagtataaggattacgcttcaaataaataaacttggcattcggaaacatttccagcaacgtttttacacgtccggtatgcggcgggttcttactcaggaactgcgagccgtgcgtattccaaagcgatatcttaacaagcttcaggaaggtttccttaaacacttccagttcctgttcggtcgtattgtcaaacaacagataccggtcgcaatattccagcatatgtttaggaaagaaccagaaattataataagtatacggcatcatgttagccagggcaaactcttcttcctgcggaaggtcgaccttcaactccatattgtcggtcgggcgtttgtcaggcatcaggaatgacatattcttcttaaagaaaggctgtccccaaagcatcaggttcgggaataccgtctgataggtggtgttgtatccgaaatgcttgtcgcacgaaaacacattgtggacgaaggtggtcccactacgccagtgacccaatatgaataccggatccatctccaacggtttgtccgcgatcttacggtaacgggcatcttcgaaaggttgcaataaactgagcagacggcatatcgactttgtcagataatacttgttgcgaaaacctttgtcgatcgttttgttagctgtcacagccttaaatgttttccagtccgctcctaccagcgtgttaattggtaatttatcaaattccagcaaccccataatttactctttatctgttatacattttacaggaacgccctggcgctccaactctttacatattgtgcgaacagcatcgtaatgttctttgcctattccaagttcaggaaggttcaatacggcaagggcatcttccgttaccatatctttcgcatccacacggtcgatgatcattccgacagccgatgtgttattggtgatcgggtcgatcaggataaatgcacctgtctgcttattcttctgatacgggtcaaacatcagttccttacccgttgtaaagacgacacgagcaatttcattcagtttcatcggcaaactgtcagctgtcagctgtccattgtcaactgtcaactgttccatagtattgacattcaccttataacggatactgtctacacgggcacgtgtcaggttcgtcgtatgtttgatgtagaactgtttggacatatccataggttcttcatccatccatactaacatggactcgaaattacggtcttctatcggcagattatccgggtgcaccagcatttcgccacgggaaacatcgatctcatcttccagagtgatggtaacacactggggagggaaagcataatccagttcaccgtcataagtaacaatactttttactttagaagtcttacgtgaaggcaacgccatcactgtatctcccttacggatgataccgctggataccttaccgcagaaaccacggaagtccaggttcggacgcaacacatactgtaccggatagcggaaatcttcgaagtttcgatcctggtcgatgggaaccgtttcaaggaagtcgagcaaagaagggccatcgtaccagggggtacggtcactcttatccaccacattatctccatccagcgcagaaagcggaatgtaagtaatatccgagatattcaacggagcaacaaactccttatagtcggctacgatccgatcgaaaacctctttgtcgaaatcgaccaggtccatcttgtttactgccaataccacatgcttgatacccagcagagataccagataggtatggcgacgggtctgtgtaatcacgcccgtacgggcatccaccaggataatcgccaggttagctgtcgaaccaccggtaatcatgtttcgcgtatactgctcgtgtcccggagtatcggctatgatgaatttacggttgttcgtgctgaagtagcggtaagctacatcgatcgtgatcccctgctcgcgttccgctttcaaaccgtcgagcagtaatgcatagtcaatatgatcgccggcatttcccatacgcttactgtcgcgttcaagagcatccagctgatcttcatataactttttactatcaaacaaaagacgtccgatcaatgtcgatttaccatcatctaccgaaccggcagtaaggaaacggagcaagtctttttgttcgtccttatccaggaattcttttatatttaatgttgacatattctttagaattagaaataaccttctctctttttctgttccatgctggcatcctggtcgaagtcgatcacacgggtagtgcgttcgctcttggtggttgtcatcatttcttccacgatcttctcgatcgtatcggcctcactgtctacggctccggtcagaggccaacagccaagcgtacggaaacgtaccatgcgcatcttgatctgatcgcgatactgttccggcagacggtcgtcgtcggccatgatcagattgccatccagttctacgataggacgttcttttgcataatacaacggaacaataggtatgttttccagacggatatattgccagatatccaactctgtccaatttgacaaagggaatacacggatactttcgcctttgtgaacgcgggcattatagatatcccataattccggacgctggttcttcggatcccactggtggaatttatcacggaaagagtagatacgttctttggcacggctcttttcctcgtcgcgacgggctccgccgaaagcggcatcgaacttgtatttatcgagggcatgcaataaagcctgtgtcttcatcaggtcggtatgcaccttgctaccatgtgtaaaaggcccgacaccagcgtgaaaggcctccatattggattcgacgatcaggttccatccgaatttctttgcatattcatcacggaactgtaccatttccttaaacttccatttggagtcgatatgcatcaacggaaacggtactttacccggagcaaaggccttttctgccaaccggaccatcaccgatgagtctttaccgatagaataaagcattacaggattttcaaattcagcagcaacctcccgtatgatatggatggattctgcttccagttcctgtaaatggcttaatttgtagtctgacatagttatatttgttattatttatatttccttcttaaaccctcactttgggtaaaatcaattccaacaatttgtttaccgactcttccagactcaacacggatgtatccaacgacaaagccggatattccggtgcttcgaacggagccgaaacgccagtaaagtcttttatttctcccttacgagctttagcatacagccccttcacatcacgccgttcgcactcttcgatcggtgtgttcacataaatttcgaggaaattttcttttccgataatagatgaagccatctcccttaattcgttgttcggactgataaaagccgctattgttataacacccgtatcaataaatagtttgcttacctcggctatgcgacgaatattctccacacggtcttcggcagaaaatcccagattgttattgataccgctacggatattatcaccgtccagaatacggcacaataatccgcgctggtgtaactcacgctccaacgcaatggcaacagtacttttaccggagccactgagtcccgtaaaccagaccatcacactacgctgtttcaaaagagtttccttatcctccctgcccatcattctgtcgaagatcggatatatgttattcgtttgtgtattactcattataaattacccctttaattagaatttccagatcattggaattacaaatacagatatcaggaaagtgatcaggttcagcggcagaccgatccttacgaagtcggtaaacttatagctaccgataccttgtacgatcaggttcgtctgataaccgatcggcgaactgaagctggccgaagccgccatacagatcacaacaaagaacggagtcggatttactcctaactgtgtggctactgataatgcaatcgggaagcttaaagccgcggccgcattgttcgttatcaattccgtaaatatatttgtaataataaatatgattgctaataatgcgtaaggtccgaaactatcggccatattgataatataactggccaccaatgctgcaaaaccggagttttccattgctttactgatcgcaaaagcgcatgcaatcgtgatcagaatatcccatgaaatatatttggtatactttttaggcgggaatatctttgtccaggccataataatagttgtgatgcagacaaagaaaaacatatccagtctcatatccgggatagcctccttcaccaccggcagttctccgactgttgcacctacgatcataaagatcaatagtcccagtgccagccaacgttttcctttcgatacgggttccgtgttttcactaccattggcaagcataaggaagacacttgattctccccaggtcgggatgaatgaatcgtctgcccaaagcaccaatgtatccccttcatgcaaggtcactttatccagatcgtgtgtgaaccgttcgcccccactcttcacttcctttacgatagcaccataatggcgtgcaaagttaaattcgcccaatgtcttattgataccggggaaacgggagcccaatacggcttccacacggtgcaagtttcccggaccttcttcttctccttcatctacgtaattatcctgacgggaatcgggaagcagtttatttgaaaaagcaaacaggtaaagaatacctgctattgcgataaagataccgacctttccaagctcgaacattgtaaacccctcatacccggcatctgtaaccataccatgtaccaccagattggtcgaagttccgatcaacgtacagataccacctaatatagtaacataagaaaggggaataaggaatttagtagcaggaagttttaccgtttcggcccaacgtttgatgatcggggcaaaaatcacaactaccggtgtattattcaggaaagcggatataaaagcgatggggggcaacatacgcacctgggctttcagcactgtggtcttaccttccggaagaagtttcttgattacctgccctaaagcaccactctgacggataccttcgctcaccaaaaagagcatggcgacagttatcatccctttattactaaacccttccaacatttctttgggacttaatataccaacgacaaggaataatactactacagaaagtagtatcattcccggtcgcattctgtcccatattaacgccgcgaccataccggccaaggctaataatacaaataatatttcaaaattcatgcgttcctaatctgtctagtttttcagataaggtgcaaatgtaataagaaaattaacgttattcgtacgccaatgtgctattttaatcttattgaccaaaataatcaggatatggaagaaatgggttttacgataaaccaggggttgtgcaaatcttccttattgtatttcaacggtgttcgaccatcgatatgaaaaacatcacatcccgcccctttggcaatagcatgtccggctgccgtatcccactccattgtcggagcaaaacgaggatatatatccgcacttccttccgcaaccaggcagattttcaagctactaccgctactgattaacgtaactggctgtccctgctttctcaaattctctataaaatccgttgtttccggactctggtgagaacgggaagcaacaacaacaattccctgatgccccatagaaacgggcaagcggactcccttttgtatgatctcgtccatagagggttgattatcacaatccacattcaacttataagcccccaaagaatcggtagagaaatacaattctttccgtaccgggacatagatcactcctaaaataggcactcctttttcgatcaaagcgatatttaccgtaaactcaccattttttttgataaactccttggtcccgtccaacggatcgaccagccagaaagtttcccaggaagaacgttcagcataaggaatatcttttccttcctcactcaaaaccggatacggacttacggaaaggacattcacgatcaacttatgagccgctttgtctgcttttgtcagcggagaattatcagctttgcgttcaatctcaaaatcagatgcaggatctgtataaatatccatgatagctttaccggcatctatcgctgcccggatagcaatgtaaagatagttcgaatagttcatcatcactcatatctatttagtttctgaatatacaaatataatgtttttttcatacaaatcagttctgagccgaattatttcaagctatctccttccgacaacctgtttttatgcatcctgcataaccagattatacttccagctgccgatcctgatagcttccgcatgtccgagcctatggactgctaatataattattcctattcaggggagttcatcacgtttttgttttcgtattcagagtttgtttatcatcttccggaggcctaaggtaaacttttcacccacatcaatatataaagtacttctttattttcttatttttgtccgcaacaacaccccggtatcacagccggataaaaaattatagaatcatggagaaagcgaatatcacgctatacacagttatcggtgatcccggacgtattgtgacagccattcaggatcgttacaaagaaatgacaaaagagatcacatcaaaaaacggaaatatcatcctgacactcctggatgactcgagcattacattcaatatcagccaccagcaggacaaaccagatttcattgcctcccacacagccggtatggccaattatttttcttcagcagagacacctctggttgaactgaaagaaaatgtgctacgtcagattcgcgtattcaactgtgtaaccggcattacattcgatataaatgacaacgaggaccggacgaactatattatcaactgtttatttgccatagccaacgacataaacggcttcctgctttatcccagcatgcagatatacaccaaggaaggtaagctgttattctccatccagggagaaagtcagttgactgaattcattccgataggcaatgccgacctactcgacggcaatcgcccggaagagtctgaagccgatacggaaagacgccttcgttctatctcgctacttaaaaagaaagatattccctatatggaacatttgcgtagtgaggcattggaaagcgaggtccggttgaaaagccgggaagagatggtgaagcgagcggcggctctgtttgcggttgccgtttactcggaagtaatattatccgaagactcagaccgggaaaaagcactcttttactttaataagatggatgagctgtacggtgttaagtcatatctgacagagaaggaaacagcctatatcgatgatccgaaaccagaacagcaaacctgtattcaattcgtttggcgctacgaatgttgcggagtattgctttgggcagccggagtcgttgacgacctttcgtacccatcggagataatcgacgtacctgtcctggctgcgatcttttggcaacacaaaggattacaggatctgttatctaaaggatattcgcgtccggaaacagaaatactggatgcggcagacctgacattgcgttatgattgggcttgtgtggatgcacgtattcatgggaaagaagctccgggcggccttgatagcggaattgttgtagaacgtcattatgccttcaactggatcatcggagcgaataacgctgccaattgggatgagatccaaccgaatacttgataaacttttatttcaaataatctctttttaagatatgaataagatcaaaacaggattagctgcttacggaatgtcgggacaggtatttcatgctccattcataaatgccaacccgcattttgaattgacggctatctccgagcgtagcaaagatctggctaaagaacgttatccacaggcatatatcgttcgtagtttcgacgaactgcttacagtggatgacctggaactgatcgtgataaacacgccagacagttctcattatgaatatgcacgccgggcattggaagccggaaagaacgtacttgtagaaaagccgttcacaacaaccgtagaacaggcaaacgagttggttacccttgccgcagaaaagaaattaagcctgagtgtctaccagaatagaaggtgggatagtgatttcctgacaatcaaagaaatattgcataaaaacttattgggacatctggttgaattcgaatccactttccctcgtttccgcaatttcatcaaaccgggaacatggaaagaaacaggagaagccggaggaggtataacatataatcttggagcacatctgattgatcaggctgtgcaattgttcggtatgccggaggctgtatttgctgacatagcgattttacgtgagggtggcatggtagacgattatttcatcattcatctgcttcgcccctccctggcacccaacataaagataacactcaaagccagctacctgatgtgtgaacgtgaaccgaggtttatgcttcacggaacaaatggttcgtatgtaaaatatgggctcgacaggcaggaagcggatctgacagatgggctcactcccgatatgcctcattggggtgaagaagagaaagaactgtggggagtacttcatacagacaataacggcatggatgtaagagagaaatatccaagccttccgggagactacggtgctttgtacgagaatatttaccagcatatccgaaatggtgagcctttgctaagtgatgcacgcgaagtggtagatgtgatccgtttgattgaagcagcctgggaaagcagcagatcaggaaaagtgattaagctgttctagtgaaattatcatatattgtgataatttattcgcacatattatgcgagtattttatcacaatatatgacaaaaagattccgtgcccaccctttctatttctttactgctgaaatcagtaacatcattggcctgcggagttcgtcacgcattcccgggatagtatccagtaaagcagcatcaggttccggttctatcaggccggtgatttcaaagccagcctggataagactgtttacgtaggttgttagtgtcttatgatatttaatgacctcttcgccaagaaaaaccgcgtttctttttccttccgtgaaataacgatcgaccggccaatgaagaatattatctgcctgatcacgataccaatcttgtgttccgtaagctgtaaagatgggatgttctactgaaaagacaaaagctcccccttgggtcagacacttatgtacattccggcaaacatcaccgaatgactccagataatgaaaagtcagcgaacttatcaccacatcatatgcttccggctgataatcgaaatcctccacagccatacatttatattctatcagaggagaagcatttcttttctgcgcttcttccagcatcttttccgaaatatcgattcctaaagctgatacggcaccattctctaccgcataccggcaatgccaaccaaagccacatccgagatccaataaacgctttccccggaagtcgggtaacatcgttttcaatacatgccattcaccagcccctctcaagccatccaccgaacgcgacatctggctgtactggttgaaaaattgttcatcatcatacttattctctttcataaatcctctttttactgttttggcaaaggtaatccaaaaacaggctctttagctgctagctgcaattatattttgacaacaatctagccatttatatagatttttatcgtaaatttgcgacgattctctcattttaataagcagagaactcattgcaataaccaattttacatgtaatgaaacaagacaagatcattttcgacatcattgagaaagaacatcagcgccagttgaaaggtatcgagctgattgcttctgaaaactttgtgagcgaccaggtgatgcaagccatgggaagctgtctgaccaacaaatacgccgaaggttatcccggtaagcgttattatggaggttgtgaagttgtagaccagagcgaaaccatcgctatcgaacggttgaaacaaatcttcaatgctgaatgggcaaacgttcagccgcactcaggggcacaggctaatgcagccgtattcctggcagtacttaatcctggggacacattcctcggcttaaacctgtcacatggtggtcacctctctcatggttctccagtaaacagttcaggtattttatatagagctacagaatataatgttaaagaagacaccggacgtgtagactacgaccagatggaagaagttgcactacgtgaaaaacctcgtttgatcgtaggtggcggttctgcttactcacgcgagtgggactacaaacgtatgcgcgaaatcgccgacaaagtaggtgctctgttgatgatcgacatggcccaccctgccggtcttatcgcagctggtttgctgaacaatccgctggaatatgctcatatcgtaacatcaactacccataagactttacgtggtccgcgtggtggtatcatccttttaggcaaagatttcgaaaacccatggggaaagaagactccgaaaggcgagatcaagaaaatgtctcaattactggactcggctgtattcccgggtatccagggaggtccgctggaacacgtgatcgccgctaaagccgtagctttcggtgaagcgttggagccggaatataaaacatatcaggctcaggttaaagcaaatgcagctgcgatggcaaaagcttttatcgataaaggttataagatcatttccgatggtacggacaatcatagcatgttgatcgacctgcgcaagaagttcccggaactgacaggtaaggttgcagaaaaagcattggttgcagctgacatcacagtaaataagaacatggttccgttcgacagtcgttcggctttccagacttcaggtatccgtgtcggtactccggctatcactacccgtggtgccaaagaaccgctgatggctgaaatcgtggaattgatcgatacagttctttctgcccctgaatgtgataaaacaatcactgctgttcgcgaaaaagtgaacagtatcatgaaagaatatcctatcttcgcatggtaaaacacattgtataggggttgcttaaaaacacagctcctatacattatattatatatacaccgtataagcggcacaaattcctgtttaaccggtataaataccgggacgaccgctagggccgcccctacgaaaaacaaaatacacaattatcaataaacttatcatttaaaacatgaagaagctcgtttcaatgtgtgcaggcgcagcactatgtattcttgcgtcatgcagtgaagggcctacaaagcagatgccttacaaccagggtatcaatgtaattcccatacctgtaagtctaactcagaacgaaggagtctttaaaatcggtaaaaacatggctttccaggcttccactccggaagcaaagattgttgctgaattttttgcctctaaaatgaacctggccacaggttatcaggtaacagtcggagataaagaagtatctaatggcatttctttaatcatcgacgaatcactggacgtaaacaacgaaggctatacactcgacgtgactgctaatggtgcaactgtaaaagctaaaactccgcagggattattctacggtatgcaaacattcatgcaattattgcccgcagaaatcgaaagcccggttgttgtaagcggtattgcatggaccaccccgtgtgtttccgtaaaagacgaacctcgtttcgaataccgtggctttatgcttgacccttgtcgtcattttattccggttgaaaacgtaaagaaacagatcgacgcattgtctttattcaagatcaacacaatgcactggcatttaacagacgaccagggttggcgcgttgaaatcaagaaatatccgaaactgactgaaatcggttcaaaacgtatcgaaggcgaaggaactgaatatggaggtttctatacccaggaagagatcaaggaagttgtgaaatatgcagccgaccgtttcataactgttattcccgaactggaactgccgggacacgaaatggctgctatcgctgcttatcccgagctgtcctgtaaaggcgaacaaggtactccgcgtatcatctggggcgttgaagatatcgttatgtgtgccggcaaggaagaatcattcaagttcctggaagatgtgatcgacgagattgctccgatgttccctagcgaatatttccatatcggaggcgacgaatgtccgaaaatcagctggaaagaatgtccgctttgtcagaaacggatcaaagaagaaggtttgaaaggcaacaaacaacatagtgcggaagaacgtctgcaaagttatttcgtacaacggatggagaaatatctggctgaaaaacacggtaaaaaaatcatcggttgggatgaaatcctggaaggcggacttgctccttctgcaaccgtaatgtcatggcgtggtgaagcaggaggtatcgctgctgccaatatgggacatgatgtgatcatgactccgggaagcggcggcatgtatctcgaccaatatcagggagatgctaagatcgaaccggtaactatcggcggatacgctacgattgaaaaagtttataactacaatccggttcccgacacattggttgcaacaggcaaagctcaacatattaaaggtgttcaatgcaacaactggtctgaatacatgtataatacagatttgatggaatatcgtatgtatccgcgtatgctcgctttatctgaaatcggatggagcccacttaaccgcaaagactacaaggatttcgaacgcagactggataatgcactggttcgcctggatgcacacaatatcaactatcatattccgcaaccggaacagccgaagggctctaccaattttgttgcgttcactgataaagcatctcttgaatttaagactacacgtcctatcaagatggtatatacgatcgacggaacagaaccgactgccgaatcaaccgtttactctgctcctatcgaattcaccgaatccggcatactgaaaatccgttctgttttgccttccggtaaaatgagcaagactcgtacgatcgcagtagaaaaacaggcattggccccagctaaggaagtgactaagacaactccgggactggaaatgcaggttaccgacggtatgttccttgaatcatccaaactggctgacattaaggaatggaagaagtcaacaatgaaagatcttcgtgagcttaccagtgttgttaagagcagcgagtctatgagaggtgtaaaacaatatgccgctattgcaaccggctatgtaaatatcccggaagatggcgtatattatctctcttcggataacgaagaagtttggatcgatggtaaactgcttatcaataacggcggtgaagtgaaacgtttctcacgtcacgacacatctgttgcattggctgccggtttacacgaaatcaaagttgtattccttggacacatcatcggtggctggccttctaactggaatgacggtagcgtgaaactacgtaaagcggatgcggataaattcactcgcattactccggaaatgctggtacattaattgagaaattgcttcttacgcctaagaaacccctttcaaacgtttaaagtgggtttcttagatgtaagaaagctgttttaaatggtgaaagttcatttcttaggcctaggaaatgaactttcaccatttaaaagccatttcctaggcctaagaaacctacattaaacgtttgaaaaccgtttctacgaagtcaggaaccaacttccaccatttaaacgaagttcccggatttgtttagtcaatctgcagctttatgatcgtgatcgagttcggaggaaatgaatagaccatcgggcctcccaaagaaaaagatatttctttctgtacgggaacgatcttttccggttctaagaatgtattacgccccaaaggatcccctgtcagttgaataatctccgcattgttctttacactgacaccttttatatccaactccgttttttcttcatggcgggtcgtgtttatcaccttcagcagtatcacattcatttctttatcccaggtcgcaacagaaaccagcgatggtagcggaggtaatacgacctcgtatatctgttttccatccacataacaactgatagtctcatccttgcagactatttttatatcataccagcgattgctttcaaaagaatgagtgcggggagaacataacgtatctttcaccgcacccgactgacgatataactcacaggagccgggagcaatcgacaatgctatatgatcatttgcctctccatctttaccattatcacgaacacgaagttgaatttgtccgctgcctttcgttcgcctgatccgcatagacaatgtatagtcgtgagccgtcgaatctcccattaacaaataattccaacggttaggaaccggaataagtcttccctcttttacatcccagcccccactttttacggtagcatcagtgacaggtttatcatcgattcgcacatcctcaaaatcataactgttatcaaacaactctatcgaagcacggccgaatgtcacctgtggacgactataggtatcaacttctgttttcagcaattcatctccccggttatttgcaaacatctgcatcatataaaaagacggcgatcccaccacctggcggttattgaatgaaagaacaggataccgttgaaattcgtaattcacattgcccaataccggagcatatgccagacgcttcacaacttccggactattttcgactccggcaaggaaacaggcctctcctatcgctgcacgcagagtcccttgtaaagaagcgtctcccatactgaactcaccgataaaaatagctgggaatctccgcagatactgcccggtctcatacctgttatgattggctatcaggaaatcttctcccgaataaaaatgataatcagtccattcagtccggagctgtccgggtatcgcagcacttttgataactgttatctccggataggcttcattgatcgcttttttgaaaagttcaaaacgtttggaatattcctgtccgtagttctcacttccgatctctacatatttcaaattgaaaggttccggatgccctgatttggcacgcatagcacccaaagtcgaatcgacaggtgcattggcatatgctattgcatccaaagcatcctgcactaatttattcatggctgttatatcttcataacgcggacgacggctttggctcgttactccgctgttaatcacatataaaggctcggctttcaaatcttcgcacatctgaagatattcgtggtagcccattccattcgtcgaaccataagcccatatattccagaaatgtttacgctcggaaatatctccaaccgtttcacgccaaacaggatacgtcccggcagtatacccttccacaaaacttcctcccggaaaacggataaattgaggcttcagtgaagcaatcttttccataagatcaggacgcaagccattaggccggtcattccatgttttctgtggaaataatgaaacaacatccagccagaaaacggcagaactatctgaagtaattgcaagaactgcattatccgtatcctctgttgcagtaaaggtatgtttgtattttctccatccgaaagctgtagatattttaaaaacatcactcaatgtcgattcaaccatcgaatcagacaaggctatatttattgtttttggagttattgtcgcccctttcatatataacgacaaatcatatttctcccctttacgtatggaaagcccgttataccctgtagcaacaacccctcctctgccagactcaggagttacagaggcagacaccaacaaggaacgacgatttttatcattgatcagctccttattatccggccacatataagtaccggcagaaatacgacgccatcccggaacggaatccaaacgcataaaaggaatagtccagccattaggcgtgatcaaaacattacggttcgcatcatatgggcagttcagaggaggtacgctttcttcaaaactacggttttgtatcatttccgcataaatacctccttcaacggcatgattaatttcttcaatagtcaatccatacaaatccttattaacaggtacggaaaaaccttctacatcaactgttattgaagaagtaacaggcatttccggctgacatccggaagacaaaaaaacaagtattacacttatacttaatatcttaatgggtatattcatatcaatatttatcaaatcaaaagcacgatagaatttcatcctgcaaacttaaagaataaatttcatatatatagttctttataataaagagtatttggctgtaaaaacctttgaaatttatatgctttctcaaattattgtcttatttttgtgctgtagagaaaacaaaaaactgcaatatatacaaaaaagcatgaagaagtcgattcttttggttgatgataagcctgagatagcgaagattataatgctctatctgtcctcattatatgatgtcagatatgaagagaatcctattaaagcaatcgcatggctcaatgaaggtaacataccggacggaattatttccgaccttaatatgccggagatgaacggagaggagtttttatgttatttaaaagcaaatgcacttttcagtcatatccctgtactgattctatcgagcgtagaaagcagttctaacagaatacgtctatttgaggaaggcgcagaagattttattctgaagccttttaacccggaagaattaagggtaagggttaaaaggttattgagataaataataaacacactagggttaaattaaacttgtatggagtacattttttgggggaataatattcctttagctgctcatttgcgggaaactctgcagtgcaaaatttccgaatgtatcactttcctgcaaataaaatcaagtttatcctctataggagaaattgatttctgcgtatttcttgaaagacaggaaatgatgacagatatacctacaattactcagcttcataagttatatcctgacttatatattattctaattagtgacaacctaaaaaaagaagataagataccttatctgaaagcaggtgttgattgtatgatctctaaggaatcgtcaaaggaggacttacaaaaattactatccgttattattgatttcaagaaaaaaaccaaaaataaacagatagaacagatatcttctttagcagagttcaaactacctatatggaaacgagcatttgatattatggcttcttccacagctatccttatgctatctcccatattaataacgacagcttttctcatcagattagagagtaatggtaaaattgtgtacaaatcgaaacgtgtcggtagcaactataaaatttttgatttttataaattccgttcaatgtattcggacgcagataagcgacttgctgaatataaaaaactgaatcaatatactaaagaaacgactgaagaagaatctttgatgtcttcttcaactcctgggatatcccaggagacacctccgactgataatgaccgggatgtccttctattttccgataacttaagtacatccgaaaacaattacttgaaaacgaagcgagatgagcgttccaacgcttttttcaaaatagaaaatgacccacgtataacccatatcggtcatatcattagaaaatatagtatagatgaacttccgcaactgttcaatatattaaaaggtgatatgtctgttgtggggaatcgtcctctccccctttatgaagcagaactacttaccagcgatgaatatgtaaaacgcttcatggcacccgccggcctaacaggactttggcaagttgagaaacgcggtgatgcaggaaagatgtctgccgaggaacggaaacaactggatatcaagtatgcgaaagaattttcttttcggatggatatgaagattattttcaaaacgtttacagctttcattcaaaaggagaatgtataaactttataagttatgaagtcatttttaatcgtatcatttcttcttattaacattttgtatagtttcggacaaaaagatgtgaatactgaaactatagataatattctcaataagtccgaaaaagttgaattacctcctctttctgtctttttagagtccgtatatgaacatccgtcaatccaaatatatgaggccaaacgtgatgaagaacgagaaacactaaaagagactcagactaaatggttaaactattttcgtgtaagtggcatgtaccaatatggaaaaattgcagctctttctaaagataatggagggaccgaagatttactatatacatttaatagtaaagcacaaaatcaatataatataggtatggttctatccatacccattggcgatttatttggacaaagacataaaacacaagctcaaaaagcacggctccgtcaaatagaatatctctatgaaacctccgtcgaagaacgaaaacttaaaatattggaagcgtacaatcaagtagtagaacaactggcaaccttaaaggccaaatcggatgcagccgctttatacaatgcacaaatgaaaatatcagaacaagattttattaatggtaaaatcgatattatttcactttcactagagcgaagcagaagatcggacgctgtagtttcctatcaggaaggtcgagcatctttacataattcgattacgttactcgaaatgcttacaaacgtaaaaataataaacagatgatatggatataaccctttacatatcacgttttttataccgaatcagacatcaagttatattcggtagtttagctgttacgttattagtaggttattttacgcaattcctacctaaaacatatacagtaaatacatctatttttacaggaatagcatccaatacaggtttagacagtgaagataaaccggacagaaatgcacaaaataatacatttgataatttgatcaacctcacaaaagctaaaggaacactagaaaaagtttccttacggctatttgctttgaatatgatccatggtgatgctacgactgataatctatacattacagccaagaacttcaaggaactgcaaaagaccgttccggaagacgtgaaaaaattaatagacaaaagctctttagaaaaaacaataaaaaacctcgaagcttacaaacaagctgttcctggcaattttttatatggtctatttaactggtatcatcccaattatagttatgcagcatgtaaaaatgtcgttgttgcacgactcaataacagtgatctgattgaaatttcttttaagtcaaatgatcctggcattgccatgaacactgttaagctaattaatgatgaacttataaaagcttatgatgaaatacgttacaaagcagcaaatgatgtcataaaatattatgaagatcaattagctactttacgtcttcaattagataacatggagaattcgcttaccaccttcaacacagataacggagttattaattatggagaacaaaccaaagctatcgctctagcttatactaattatgaagataggtatgaagccacattaagagaatacgaaagttcgaatcgtttgatacaacagttagaacaacagatgaatattcgctccaaactatttcaaacaaatacagaatttattgcagcattagatagtatatcctatttcaatgaaaagataaccgaaatagagacctttaatgctgaatcagcaacgacaaaaaacaaacagcttgaaaaatataagtctgatttaaaaaacacagagaaaaagatagagcagttatctgatgaaattaatgaacacaaatattctaaagaaggagttgctatcgaaaatatggttaatcattggttggccgaggtgatccgtaacacaaaagcaaaagcagaactaaagatattagataaccgaagaaaagactttgtagaacagtataaaagattttcccctgttggtactcagattaatcgtaaagaacgagaaattcatattaccgaagaatcttatttagaaacactacacgctttaaatatggccaagttgaagcaaaaaaacattcagctgacatcagccacattaaatgcagtgactcctcctacatatcctttatccagtgataaaagcaagagaagtttatttacactggttgcttgtcttgggagtattatttttatcatcggatgtaacttagtcgtagaacttttggatcgaacactgagagacgccgagcgcacccaacgacttaccgggacttctgttttaggagctttcaccggaaatacacaattaaaataccgtggttacataaaagcttgtaaccgaatttctgctgcttatgcatgtaatcggatgaatcaatatttacatccagaaaaaacaacatatatcaatttactaagtatagaaagtcgggaagggaaaagttttgttgccgattacctgatagataattggcaagatcaggggttgaaagttcgtcatttaaaaatcggagaagatcttcctaatgattgctcctttctgttgacttccggatatgacgctttactttccaaggaagaagaaaggccggatatattacttctggaacttcctgctgtacaaaataatagtttaccagcttctctattgcgtcaagctgacgtaaatctattaattgcaaatgcatgcagaagttggaaacagagcgatcaaacatttctgaatcatctgaaagagatggcaacgacagctccattttatatttacctgaacaatgccactcgcgaaacagtagaagaatttacagggcaactaccaccttatacttctatgcgaacattagctaacaggcttatatatatgggacttacggcacagaacacagcaatcaaatagaatttaatattaaaataataatgacaaacctgttgagtaaaataaatttatttcagctaatccttattttaggactggcaggaattgcattatctatactcacaggaaatttaatactgtcaatcgcaattatttcactgcccctattatttgttatgtccatacaaattcttaaatatccaatattaatactttataccatatttacattaaactattttattttaggtgttggacgctatgtagaattaaacggagtaagttttctcatggatatacttatggcgatagccttaattctaattattacccatactgctctatctaaaaatgtggattggaagccagccaacaatatactcaccgcaggaactgctatttggatgctttactgcttggctgaaatagctaatccatcgggtatggtaaatgcctgggtattatcaagaggcctcgttataaatggatttatcataactgtattgacatctgtttactgtgcccgatataaatcggtaaagacattattatttttactgtccatcttttcacttatggccgttctcaaatgttttcagcaaaaatatattggatttgactatgcagagagtaaatggttaagaaatggaggagcattgacgcacctgatcggcacgggaacccgatatttctctttttttactgatgccggtaattttggctccaatatgggagcagcaggagtaatttttggtattgtagctatttcttcccaacggtctacaaccaaaatatattatagtattgtcgctatctgcagtctatatgccatgctgttatcaggtacgcgaggagcaatgatcgtacctttaggtggccttgcattatatacaataatcagtaaaaacgtcaaaagcatggttataggaagtatcaccttaatgcttatctatatatttttcgcattcacaatgatcggacaagggaatgcacaaatacgcagaatgcgtacagcttttagaccttccgaagatgcatctttcaatgttcgaaaagaaaatcaaaaagtattagctgatcatttaaaagacaaaccctttggagaaggcctgggcttatctggcgtggaaaatcaaaaaacatccatacgactcacaacccttatacctcacgattcgtggtatgtaaagatatgggtagagaccggtgttgtcggtataatactttatctgggaatgttatatatagccattgcccgaggtgcttatatactaatgtttaaaatacgaaaccaagagctcaaaggtattctaaccggtttgctatgtggtattaccggactactcctaagtgcctatggcaatgcattctgggggcaatatccaactcatattattgcttttatgggattgtcgctcgtattaaaaggtgaatatttcgataaagaactggtcgttgcacagccagaacaaacaataaaacaagtcgtgatacaaaacaaatgatatactatggatcaaattaatcaattaataatgacctgggttcagaatgaagactctatttatagaataatagatgctattctattcttgcttttcttgatagcagtactttatttgctgatttttgcaatattctctcttaaaaaacgcaaaaatacatatccaccggcacgcaagagatatcgctttgctgtacttttcccatgctatatggaagatgaagtgatactaaattccgtaaactcttttttcgatcaggaatatccccgcgaactatatgatgttatcgtcatatccgaccgaatgacagaagagacagaccaggcacttcgaaatctttcagctctggttgtaaaagcagatagtcctcaaagtaccaaaaccaatgcactcagaagagccattagatacatagaagaagaaaaacgtacttatgatattgccgttgttttagatgcggataatctggtggatcttgattttcttgataagataaacgatgccttttattctggctgtatggtggtacaaacccatcgtgtagcaaaaaacagaaatacaagtattgctgttctggatgctgttagtgaagaaataaataactctattttcagaaaaggccatacggaactaggcttttcatctgcattaatcggttcaggaatggcttttgactaccaattatttaaagaatatatgcaaacggctagttctatcggaatagataaaaaccttgaaaagtcactgctaaagaattacatttttatagagtatttggaaactgtttttacatatgatgaaaaagtaaaacaaaaagcagatttctataatcaacgccgtcgctggctggccactcaattttacaatctgttctccggccttggtcatatattgatagccatactaaaaggcaactgggattatgtagataaactattccaatggatgatgcccccccgcataatgttattcggacttatcacacttatagctattggcatgacgtggataaattgggctctgtcggttaagtggtggggattactactactactttgcataacattcagtatcgctgtacctaattatctggtagataacaaatttaaaaaagcgatacttagtattcctcttttattcattttgatgcttttcaaccattttaggatgaaaggagcaactaaagagtttattcataccaaacattcttcaaaataagcattatgaaaatagcgattgaagcccagcgtatcttccgaaccaacaagcatggtatggattttgtagtacttgaagctatccgtgaacttcaaaagatagacaaagaaaatgaatattttatttttgtcagtccaggtgaagatcgatgtttacaggaatcggataatgtacatattattgaagtgaattgccccacttatccattgtgggaacaattggccttacccaatgctgtagctaaagtaaagcctgatttattacattgtaccagcaatacagctccaatttacagtagttgccctttaatactaactcttcacgacattatattcctggagccccgtcaaagcggcaataaatcatggtaccagaatatggggtggtattatcggcgaatagtagttccccgtatactcaacaaatgtaaaagaatcatcactgtttcccattttgaaagtaatcggatacaagaggctttatgtctttcccctaagcagattatagctgtatataatgggtacagtaaacactttaaaccactggaagatacaatttctgtaactaacaaatatattaagtcggatcaatttcttttctttttaggaaataccgaccctaaaaaaaatgtgcctcgtacattaaaagcatatagcctttatcttgaacgttcggggaaaaaacttccattactgattgccgatctgaaagaagataaacttgatgctattctgatagagcaacagatagaacaaatcaagccctacctctcctttcccggttatatacccaatactgatttggcctatttgtatagtggtgcttctgcttttctatatacctcgcttcgggaaagctttggtatacccatgctggaagctatggcctgtggaacaccggtcataacaagtaatacttccgccatgccggaaattgcaggagaaggtggtatccttgtcaatccgttcagtgaagaaaatatagctgatatgttattaaagctggagaacgattcggttttttacaaagagcaggtagagtatggcctggaacgcgtaaagcatttttcctgggaagacacggcccgccagctacagcatatatataaacaagtaataaaatctaataactaaactatcatatggaaaatcagaattttatcataacaagtttacagccatgggacttagaaataggtagcacaataaaaaatacagcactagagctttctaaaaagaaccgggtaatgtatatcaatacacctatggattatacaacttggctgagaggagacaaaaacgcagcatataaacatcgtatggaggtcataaaaaaacgcgtttcgaatattcggcaaattaatgaaaatatgtgggtaatcgactgtcctttcttactatatccagtaagtaaacttcctacaacctggctatttgattatataaaccggattaataataaaaaaatagcaaaactcattttagaaacaacaaccatattaaattttaagaatgcaatacatatcattgacactgatatatatagaagtttatatttgaaagaattaatcaatcctaaattatcagtttattattgccgtgattacgtaatcaccaaagcttattggaaaaaaaacggtacacgcctggagccaataattgctgcaaaagcggatctcgtacttacgaactcaacttttttttctgaaagatttaaacaacataatcctaatacttacgcgatcgagaccggagttaatttagaattatataacatatcaagaaattatattatacctaatgatttacaatccattccgcaccctatagtaggatatgtaggcaatataaacggtcgccgacttgatagcgatcttttgttatatttggcacagcaacgtcctcaatataattttgtctttgttggatttgaggataagcattttagccaacacctactccatcaacaaaagaatgtatactttctaggtaaaaaatcaacaaatgtacttccggattatatttacggattcgatatttgcatcaatccccaaattgtcaatgagatcactgaaggaaattaccctttaaaaatagatgaatacctggctatgggaaaaccgattgtagcaacccgtactcacacgatgaaggatgttttcagtgaatgggtctttttagcctctgacaaatctgaatacttacttgcaatggattcggcaatggaggaaatcaacaacaccaataagaataagggacgtgtagcattcgcacatactcatagttgggaaaactctgttcaaaaaatttataattgtatttctaattcaataaagaatggaactcctatacaaaataaaacgttatgagaagctaaaaccatttctggtctggcttatttctcccaaacgcaatcctaaaccacgttggtgggtcagatggtttgtgactccttttattttcaaaaaaggtaaaggggcaatgattcgtagtaaagctcgcttggatatattcccctggcatcgattttcaatgggtgcgtatgcaacaatagaagattatgcaatagttgcaaatggtgttggtgatttgattataggtgatcaagtcagaattggtgtcggttctgccgtacttggacctgttaccttgaaatctggatgcggactagggcaacatgtatttatatcaggttttaaccatgaatataaagatcctaatacgaattctaaattccaagggttggaaaaaaaaccggttattatagaagaagatactcatatcggttctaatgctgtagttgtagctggagtacacatcgggaaacgctgtcaaattggtgctggaagtgtagtaaccaaagatgttccagattattgtattgttggcggtaatcctgcccgcatcttaaaacaatatgattttgataagaaagaatggataagaattccaaaagtttaaataaaatggtatctattataaccatcaattacaacggatataaagagacatgtgaacttattgagtcatttcatagagtggaaacttatccctacgaactcattgtagtagataatgcctctaaagaagatgaaggtaagttgctcaaggaaaaatatccggatataatcgctgtttacagtgataaaaatctaggttttgcgggtggaaacaaccttggataccaatatgccaccggggaatatattttgtatataaataatgatataacgatagccgctccctttttacaaattttaatctaccgtttaatatcttctcctcttattggtgttgtatctcctaaaataaaatatgaatatcaaccagatataattcaatatgcaggatttacccctatgacatctattcttctcaaaaatagaatgattggtgaaaaagagaaagataatgggcaatatgatcaaccctgtcatacaggttttgcacatggtgcctgcatgttaacctctcggaatatcttaaaagaagtaggaactatgacagaagtctattttcttttttatgaagaaatggattgggggctacagttacagcgagcaggatatgaaagctggtatgaaccagctgcgactgttttacacaaagaaagcatgacagcgaaacggaatagtcccctccgcacatattatatgacccgtagcagaatactatttgttcgtcgtaatagtcgtggatttaggaaattactggcgtatctttatatcctacttatttctacctctaaaaatgtattctgctatctcataaaaagacaaacaaaaatacttgtcgcatttctgaaaggtactataagaggattcactgataattcatcaatgtatagcaaataaaaagctctcgaatagaattaacaaatgagaacaaatataagatcaaataagaatcttcacatagaaacattacgaggttttgccattatacttgttgtaatggaacatataataggttcgactcctgatggaggaatgaaaatagattttccttctccctggcgttatctatatctatggattgattttatacaaatgccactttttacagcgatagcaggatgggtttatggattaaagcttttaaagaaagaatatttttcttcctttttaaagaaaaagacattccgactattagtcccaatggtgacagtcggtactctctatttcacagtacaatacctaatacccggaacaaatagtaaggggagttggactgaaatatggaaaatttatttgttcccatatactatttattggtacttaccctctcttttcattatgtttcttctacaaggcataatagatataaatggatgggcaaacagtctgtcaggatggataaaatgttttattggtatctacctattaatgattttacaatcaacttgcattcccaataatatacctaatctatttagtttcaaaggagctctaatgcaattcccctattttattacaggagttggtatttgtaggttttcaaaagaaatttcatccaaatgggtcaagacatcatgcctgatcgccgtctgtatcggattactacttcttcagatagattggttctattcattacataataataccatttataaaataacacaacctctatgggctatttgttcattatactttatattgagaagctctgtcactaataatttccttatccgaattggcagctatgcttataccatttacttatttcatggctttggcacagcaggaggacgaataatccttaccagatcaggagttcactcagaaattataatctttttatttgctttatttattgctatttttatacctattatactagagaggatattaaaaaaatgggaaataacacgaatgctctttctgggggaaagtgtagtgtcttcaactccaattcaaagaacaggacaatagaggctccgaaagtttcataataacaatatctgaataattaagcaccatgaaaaagttagtagctgctctcattgttatatttatgacatcttcatgtctaaaagatgctatagacctattagacaaaacaataaatcagacctttacattgaagttacctactattaaagataatattgaaattccaaacaaaataaattgttatatttttaaagacagcgttctttacaaagtcttacataatctgacaatagagagcgatagccgtattgtaatagatgttccttcaacagctcaactctattttctagccaacacagaagagcctctatcattggcttctttgaaagaaggagaaaaaaatctctcttcttttttattaatatgtaatgaaaatattgaacataatcaatgggggggagctatattttattctggatcagtgatgattgatccggctttaaatactgacaatagaatcgaactattagcctccgttgcacaaatagatatagatgccggttcaaatgagctgattcaaatagacagtatagaaatgtcaggagcatcattaacaactccactatttaaaggagtaggacctgtttcatctaccaataaacaaaaatatttacacagtttccctgaaccagtatccggcataattcataatgtttttagaccttatgaaagcatcactcctgttgaattcaagattaatggaacctataataaaatagcctttgttattgatacaatcataccgatattagaacgtaataaaacttatactttagaaattgaagataaagatataaaaatactacctgatacgaatgtacacataataattcccgattcaaaaggtcggatagatatacacgcagatcaaacaaaaaaaatacaaccaggtagtactatttatttagtcggtaatttcttaagcgttcgactcacaggcttaaaaggaaatgcagaacatcctattcgcataacgaactatccaggaaaaaagcttgtaatcggaaatcctgattgggctggaggagccaattccagtgcgatacaattattagaatgtcaacatataatattaggcagtgaaaataatgcagctgattttttaattaatggctctacatcaaaagtaagatctgcctattttggagtcaaccttaggcccttcactgataatgtagaggttaaaaatataacaattaaaaatggaggaactggtattttagccaaaacagatccggaaaaaaataattcgaaaacatggtatcctaatactgtactcgaaaatctatcgattcatgacgttatcataagtggtgtttccactgaagggatgtatataggacacacatctgtatggtggggatgggatgaagcaggaaaaggatacaatgcaggagcgaaacctaataatccaggacatacttatgttatgcctgttaaatggaaaaatgtaaaaatataccagaatcatgtatctaagtctgggtatgacggaatacaggcatctgcaatagatcaattagaaatatacgaaaacgaagtttcagattttggtacggataacacatgggggcaaagcatggggataattgtaggaggacgtacgacctttacaaatgttcatgacaattacgtacacgacggaacaggagaaatttttcaatttcatggatctggagagaacaattcaacccactttatccataataacttgtttataaactctcaatccagtggaatggggatatatggcttaattgatgccgcaactattaatataaccaataataccattgtaggatgtcaggtttttgctattcaagtaaatggaaaatcctacgaaacccttgtaaaattaagcaacaatgtctttgctgaatgttaccaaaaagacctatcttcaccaaagtacatacgaataatgaacaaaggaaaagtcgaagaatccgaaaataaacaattcgactccattacaaatgcgaagctggacccagacaacttttatcagccacttcctggctcttccataggaaatgccggatacaggcatacttctaaacgataatagaaaatatgtgctatcagcagtgagaataccacactactattttacgatttttctcaatgtaataagcggatgtaaaattgcatattggatacgattcttattatgtagaaaagatagatagataaaacaacatgacgagttcttgattccaaataaataaaaagcaaccttattttcccaacgaataggatactttgatttaatctcatcaatcatcgttatcttcattatcagctctttcctgattgtttccgataaattagagcgtaaaacgccttcacttaaacgtaaacaaaactctatgatatcatcaataatataaggacagtcagtagctatactatttaagcaaatagcctttttctcataatccaaaacctccaaataggtattgactttttgaacagttaacccagttgctttggtgacattggttgttgaatcatttcttacgtaccagttataagtaatcgcatccagaaaagtaaaagaagaagtataataatatagctgaaaagaaaaccagacatcttcgttcaaagaatgaggaatacaagttatattatttcttttcaaaaatgacaaatcataaagcttattccaggtcattatataaaaactacgctcctgcccttttctatatttagccaaagcataagattccttactggttatatattgaaattgattggcagacagcatatctccatcaaaactaactttttgaaaagaagccgcaacaaaatcaacaggattcttcttcatctcctgatataatatatctatgcaatcaggagtaatcacatcatcactgtccataaaatagagatattcacctgttgcttcttttattgcagaattctttgtagctccagttcctcgattaaccatgtggtcaataatcctaatatcttttccacgaggatgttcccgcataatccgttcgactatctctatactattatcggtccctttatcatctattatcaaaaactcaatacttgcaaaagtctgatttaatgcagaaagtaaagatcgttctatatatccagagacattatagaccggcatagccaacgttacctgataattcattttatgacacatactttcttgttattttattttttatgtatattatttcctccaaacgaaacaaatatcctacaaataaaaagataaagacaccaaccagtccccctccaaagagctgtaaaaagatattttgtacgacatttataaacaaatagactactccccccatccccactgagagtaacaatacaggaaatactgtttttatctgtaaaaaatatccagtattaattacctttttcgcaaaatatacgattatcacaaaatcaaggatattatatagaaccaatccccagcacaatattcgaactccataaggaagagttaacaataaaataactacagctatcgatttctttataatttctgcttttaagaaataatctgaacgcccttttacatttaaaatattattatttagtaccaatatgggataccaagcataggctatacacagaatagacaatagtccggctgcttcaatccatttatccgtaagaataaaaaggattaaaggtttggacaaaactgaaagtagaatcattaatgggaaaataataaaacaggaaaaacgtaaataaagagtgaaagaggcttccaattgtttatcatcatcctgtatactacattgcattggataaacaacccggcttattatacttacaatatttatagaaggaaattgagccaatgaatatgcacggttgtaatatcccacatcagaagccttataatatcgtccaatagccaggctataaagatttatataaacagtatgaagtaagcccgatgcaagtaatttggatccgaaagaaaacagttttttaaaagagtcccaagaaaatgtccaggaaggactccatttggcataaatccataaaagcaccgtattcaaaatattatttgtaatattctgaaaaatcaacgcccaaaccccttgtccggtataagcaagaaataagccaacaataccactaatacacactgacgataatgaagctttcgcttgactcttgaaatcaatctgtattgtcagctttgctcgttgcacaattgaaaatgcagtaataattatgttaatccctacccacctggtaattattactaattgttcttcgttataaaaatcggcgataagaggtgacagcaaataaagtaataagtaaacaaaaacagatattacaacattgaaataaaaaactgtactataatctgtttccgagcgatctttcttttgtatcaaagcgttggcaaatccaccatctataaaagtttgagcgatagccataaaaatgctcagcatggcaaccagcccataatctgaaggtagaagttgacgggcaataacgatacttaacaggaattgaatcccctgcacagaaaaccgctcaatagcactccagagcacactcttagtaacttgttttttaactgacattttacccttatttatttcaaaacattcttattatcctcccccttaacaaatcgttcccaccagatagctaaagttagtaaattgaaatactggatcgctttattctgtttgtaccagaaccagttaccatcttcgtgtacttccttatcatattgtcttataaatacttcaactacatttcgatcaagaaacgtatcaaacatagaagagttcatgatataatcggctaccttggatcgttgaagatcattcttaaaaaacaatggcatcggagcaaaaccgccttgtttctttttggatgttattacttcaggcagcatgggtttataatgatatttcaataaatattttgcagtagcatgccctttagctatatcagttacattcccccccttacatttatattttacaggcaacttttgtaaaaattgatacaaatcaagatccatgtatggaaatgtaattctattatcaaacatttccgccattctggtagctttaaataatatcacctgatttataatcttttccaaatccgttttatatgcatgctgaacatagagatgttcaaaactacggatatccggctcgattgtatcaggggtactcaaaaaagacttttcctgtaacatctctttcaaacgaaagtccgggaacccaaacaagtctccctgaagaatattcagtactttatccaaatgaaaccgaacacggtaaaaataattattcttatcgaagcccgactggcataataaacgataaacaagctgcataagcggagccatcttatacttggaaataagataatgaagagcgacttcacgaccggaagttccaaaatattgatcactgccatctcctcccagaataatctccggtttattatcaccgattaacttcattgctgcatagtttaccattaatccaccttcaacaaaaggatcacccagatgtgcaacaatatcgggtaacccggaaagttcactaccatcaatctcatattcggtgtgtatagtaccaaaagtatcagacatacaacgtgccaaaggtaattctgtccagttatctcccttgaatcctatggaaaaagaacgaatattaccagcatatatattacgcaatgcagccagattacatccggagtcatatcctccactcaataagataccaacatcttgtttattgtcaatacgttttttaatcgcttttatatgcaaacgaccatattcttctgccagttcatttagatctccatcactcaaaaccggcataatatcatcggtacaatacaaattctctaccttctgtttaccttctttatatatcagtatttctcctccaccaagtttatgtacacctttcactgctgaaaaaggcgttgcaatatagcctatattaaggaaacggcttagtgcctgaaagtccggttcagtgataaatccatctgtttcctgcaacagagataatgaagaggcaaaataacgatcagtgtaatagaccggtttactcgtcccatgatggtcacgggctataagaatgtctctgccttcttgtatcatcaatgtatatgatccatctgcctttgctaatcctttcaaaccgtatatttcatataattcggaaatcacttcggcatctgactgatcagatgtatagcctaagactttcttattatacagaacaccccaaaagtatatctcaacttttttattcttataaacagagcaggattcgtcatatataatatgaccataagtctttgacaaatatttttgtggaaagactcctttattttcaaatttaccgataaacatagattattattttactccgtgagatgtatgaatgaattttttattagcaccttttaaacgaaacaaattacaaaacatcagtaaaaaggaataaggtaattcaaataaggctacaaataaccttttatttaataaggttctaggaatagctaaaaatagagctaacaccagaatcaagaataatatccaccattttaatgctatggtccatttgataaaagagaagactaaggatattataaaaataacccccaacaatattattcggggaatactcatttgttgaaagactttatcacaaaaatcccagttacccttttttatagcattcggaacgtctgctataaattccaccaaatagtgtaactgcgccgataaccaacgacgtcgttgatcagaaaaatttgcatgactttgaactttctcatccaatacatcaacatcctgtaagtaatagatcttttcaccctcttttattaaagacaattccaatgccctgtcaaatcctcccacggcatttattgaaagcataatctccttaaataaagtataattgaatgccatgcccgaaccgatcaaagctgcagataatcccatggtagcatgtcccaatctaaaaatactattattaatttcttcactgactgcatccaaaacagataagtttgtattcaaattctttgctttacgatgtgcctgaacgatcctaaccccaggagtcgaaaaaaagttattgatattttgcaggaagtcagcatagatcacgttatcggcatccaatactactgctatatcgtaaagatcaccgatttggtccattgcaaagtttagagctttggctttagtgctattttcaaaatggacatttaccaacttaaccggaagagacgacaatatctgatcggtaccctctttcatccggtctgagataaccacaatatcgtatttatcggttggataattctgattcatacaagacgcaacacattccataataacccgatcctctttgtaggcaggaatcaaaattgcaatccgctttgtaacagaagataaagagctattccgttccaaatgcagatgagaaacaatactgaacattagtaaataaacaacgttcagaacagctactacaaataaaattatttctaaccaatgcaacaccaccatattttataaatttacaaaaacgcaagagctgcaaaaataataaaatccagaacacaaaaaccaaaaacacgttatttttcatagtcttttaaaaaattctttatttgatgaattgttataaaactttattatatttgcaaactataaaaatatatttatatcaaaatatcagtatggattcattttatctgactattaagtacttattctggataggaatatttatcgttttctacacatatctcggatatggtatattattatatacattagtacggataaaagaagtatttcataaaccggtcagatacgatttaacagatccactccccgaagtaaccctcttcattgccgcatacaatgaagaggatattgttgcggccaagatgaagaactgtcatgctctctcctatcctgtcgacaaactaaaaatagtttgggtgaccgacggctcaaacgatcatacgaatgaatacctgaaaaaatatccggaagtaaccgtactctttcaaccggaacgcagaggaaagacagctgcactaaaccgtggaatacagcatgtgaccactccttatgttgttttcacagacgccaatacaatgttgaatgctgatgcgatcacagagatcgtccgtcaattctccaatccaaaagtcggttgcgtagcgggagaaaaaagagttgaaacggcaaccgcacaaggtgcaactgccggagaaggaatctattggaaatatgaatcagcattgaaagcactggattatcgattatactccgctgtaggagctgccggcgaactatttgccgtacgaactgaactatttgaacaaatgccgcccgacacactcctggatgatttcatcctctctctccgtattgcacagaaaggatataaaatcgcttattgcaaagaagcttacgcaactgagactgcatcattgaatatgaaggaagaagaaaagcgtaaaatacgcattgctgcaggcggtttgcaatcagtatggcgtttacggagcttgtttaacatattccgttacggcacattgagcttccagttcataagccaccgggtcttacgatggaccattacaccgattgtcttattcctgttaatccctttaaatataatattaacatgtaagagtgagtttacatatatatttttactacttttacaagtcgcattctatataatggcttatgcaggctatttgttggagcggcgaaacttgcggaataaactgcttttcattccttattacttttcttttatgaatataaatgtcataagaggatttttctatttagctggaaataaagggaatggggcctgggaaaaagcaaagagaatataataagaaaaatatttctaaaatgcgataatgaaaacctctgtaaattcaaacattattaatacatttgtgtgctgatagtgattgaatatcaagaaaagtgtaaattaatatggataatttagcatcagagtatactgtattgatcgtagacgatgttccaaccaacgtcatgttagtacaggctatattaaaaaaagaaggatatacactattgacctgtgacagcggcgccaaagctcttcgcattgctcatgacaaacatcccaatctcatactactagatatcatgatgccggaaatggacggatacgaggtattacaacacctcaagagcgccccggacaccaatgatattcctgtaataatcatgtctgcacttagtgatatgcagagtatagtgaaaggataccagttaggagctaccgaatatgtcacaaaacccttccaaagagaagaactggtcaaacgcgttgcccaccgttatgaactatttagtattaaacgcataaaacaggaactggaaaatacaatcgaatcacgcgatacactctattctgttatagcacatgatcttcgttctccactcggttctttgaaaatgatgaataacgctatccttatgatggtagacaagagccaagtcagccctgaagtattcgaaatgcttcagatgatgaataaaacatcagaagagattttcctcctgcttgacaacttgttgaaatgggcaaagaaccgcctgaaaaagcagaacatatataaacaagaggctgatatcaacagcttggtttccagtaccgctgaaatttacattccgatggctgcccaaaaaggcgttagcctgcagttgataaatgtagataaggaactggtaggttctgtcgatatagacatgataaagacagtggtcagaaaccttatttcaaacgcgatcaagtttagtttcgaaggaggcacaattgaagtttcgactagtattgaaggtaataatgtaattgtcagcgtaaaagactccggtaaaggaattaagaaagaagaccaggagaaattgctgaaagccaacacgcattttacctcttacggaacaaacaacgaaaaaggttcgggattgggattgatgctttgtaaagacttcgtggaactgcatgatggtaaattatggttcgagtcggaggaaggtaaaggttcaactttcttattctcccttaaagcattgaataaagaataaataccattcaatatagaaaagaaattgaaaaagggaatgtattcgttacattccctttttcattactatcacattcagatcggaagcgaatttcttatattcagaggcggtcatctcaccttccgtagataaaacaactaacgaatgatccggatattcacttctgtaagccggatgaatatgcggaaacggattttccacaaatccatacgactgataaaaacgtaaccgggctgcagatatactatccaccacagggtctatctccaatagtacacgtccaccctcctgctctatcagatttttcaggatcaatccacccaaacctttaccacgctcattcggatgaatagcgaaatgctccacatatatataaccatcaaatctccaataagcgataaagccttgcaagaaaccggtattcttaccgacataacaatccagataaaagcggctatccgcaaaagcatccttctgctgcacttcagtccgttgttcaaagacaggaaaactaacatcatatatctccctgaatgctttatacagcaatgcatccgttgttgttattcttacaatctccatacgattctttttttatttaagcaggcacaaagataaagcttatgacaaactaatcaataagtcactacttattatatgaaaagaagggacttattgttgctatgatgtacaccctggccgactaccctgtacaggctgataaaccggggtgtacaggataatcgtccaggatgtacagggtaacgatagtaggtcgggactcttgaactaattgatagtatgctttactctaaaagggaaggacgtaaacaataaaaaaagcggctaccgggttgtatttcccgatcgccgccttttgcgtttcctgtatatccggtcgtttgttactgcatacgacggataccgatagctttgttatactgagccagagaggctttctgctgataccaggtctggataagactgctgtaagactgtatccatgatagctgggcagagagtacatcgacaataggaagcttaccttcattatagctgaatgtattcaggtcaaggttctcttcggctattttgcaggcatcttcggcaacatcgatctgcttggtattctcagtcagactggtccaggcattagctacttcctggccgatctgatcgcgggtattgtccatcgcatattctttgctgcgcaggatcgctttttgcgagttcacttccttgaagcgtgctccccaacggaacaaaggtattttcagagaagcaaagactgccggtgtccatagctggtcggaacctttcatgttcagcataggagttccccatgatccctgaaatccgacggacaggttcgggttatactttgctttggaaaggttgatctgccgtttctgatactcgatattcaactgggctatatgaaagtccggacgattatccaacgctgcagactcacccacacgcagaggcaacggttgatccattgtgatggagtcggcaatagccacctcttccatcgggggaactcccatcaggacgttgagattctgtaaagcgatctgataatctttataggcagaacttttgttcaactccgcctctttcaggcgggcctgtacctgcaaaaggtcggtcttactgatttgtccgtcctggaaacgaagcgtcaacacgttggccaactcctgtacgatatcgacatactgggtcattacatcatacatccctttgcgggcggctaccgaccagtagttcatatcggcggcataaacgatgttatcggtcgtcagttcttccacctcagtggcaatctgtccctgtatctcggctgccttatagttgttgtagatttgtcctccggcatagataggctggctgacagttgctcccaggctataagtgttatgatccatttcataacccggcatcaattcgtacttattaatacggtactggtaactaccggagaaatcgaccgccgggaagaatgcagtcttagcagctttaatggcgtgctgcatagcgatccgttcttcggaactctgcttgatctgacggctgtattcaagcactttttctttatattcggctgctgtgatgggctgtacctgcgcattcgcagataaagcacccaacagcatacaacctattatcagtttacttttcatattacttattccgatttaatcttaaagaatatacaataggtaaccggaagcacgaagatggtcaggatagtcgatacaaacaaacctcccataatcgtagccgccataccggcaaacatcgcatcccccaacaaaggaagcatacccaggatcgtagtacccgaagccatcgtcacaggcacgatacgtgtcttggtcgcttctatgatagcattgacaggagccagtccactatccatctggagacctatctcatcgacaagcacaatggcattcttgatgttcataccgatcagccccaatagtcccaacatcgcaaagaagtcgagagactttccgaagaccaacaatcccaatactaccccgataaagatcaacggaagcattgccatgatcaataccggtttccggtaatatttcgggaagaggaacagtaaggtaatataaatcagaccaaacatcaaaggaatgttagctgcaatagccttattacctttatcctgttcactttgttctccgaaataagtcatcttataaccttcgggaacctgtatttgtttttgggcttccgtccaaagatgactgaatgcagccatcgtgttggcaccgcgtttcggctcgcactgcatcatcatatacggttgacggttgaaacgccttaccacattgtattcgtaatcgagagagaaatcgtcgattacctgctctaccttgactgaacgtcctttggcactataaaccggcaacgtcttaatatcgttcaggttcatagagtcgcggtcggcatccttcatcaggataggcataaagacatcgccttcacggtactcaccgagcggaacaccgttcgttgccgagcgaagggaataagccacctgctgacgggtgatacccagacgcaaacctttttcctgcgaatacaacggcttccataccggaactttattgccccagctatcgcgcacttccatcacctggtcgtactggcgggctatctccttgactttctccgttaaagccaccagagtatccacattatctccgataaaaccgatctcaatagcggcatcgggcacaggagacaaagcgaacagggccgaacgagtcaggatgttcggatagtttgctaccatataatcgtagaatttaccttcttccgcttgtgcatcttccgccttttgagtttcgatcaatacattcgcaaagttaggcttcggtcccaccgacgaacttgccaggtaataacgaaccggggaacctcccagggtaaatgagtacgatttgatgttcttattattactcaggtaaccttcaatctctttcacgctcttctctacatcgtagatactgtaaccttccgggaagatcaggtcggcacggaaataaggcttgttcatgatcgggaaaaagctctgcggcatgatccccataataaataaggaaaggaacaaggtcgcaacgacagaagaaacggttacccatctgcgtttgataagacgggccagaaccttttcaaacttatgatacagtttcgtatcgtaaggatctttcgcttcacccggtttggcttctttcaggataaagttaccgaaagtcgtagtttgcgttaatgccaatacccaactcaagcctaacgatacagccaatacgataaacaatggtttaacgatctcggctacagcggcaggtgccaggtacatcggcaggaatgaacagactgcaataaaggttgcacccaataaggcccattgtggcttggttgctccgtctaccaaagcctggtagcgggataacccacgcttgatacctacctgtgcattatctgttaccacaatcgcattatccaccagcatacccatcgcgatgataaatgcagccagcgaagttcggttcagtccgacaccccagataagcataagcagcaatgtaccccctacggagaagagcagcgaactacccacgagcatgccggcacgcgatcccattacaaggaaaatcactacaataacgatcaacaacgattcgagcaggttaaggataaagccgttgttcgcttcatcggcaatcttattttccggatagatggtcttcaaatccatgccgataggaaaaagccgttccatttcttccagatgggcagcgacatcattaccgacagccactacgtcatcattcggtcctgttgccacccctataccaatagctcgtttgccgtccacacgcatcaggttggaaggaggatccatatagccacgttcaataatagcaatatcacccagacgcacttcacctccacttttggtaacaatcaactggtcgcgtatatcctgtatatctttataagtaccctcagctctcaaccgcaactgatagctgccggtattgatatcaccggtattgaccaacaggttttgtgtttgcagtacctgctggatagagttagggtcaatccccaggttagccagtttcggtaccgagatccttacattgacaacttgtgtctgttcaccaaacagatacaccttctgtacgccaggcaccggagacaattcagtcttgatcttttgcgaccagtcacgcagttcgtcataagtaaatccatcatcggcagtcaaggcataatagataccgaatacatcaccaaagtcatcgctgaccgatatggaagaggcaccgctcggaaggcggggttctatatttgccaccttacggcgaagttcatcccatttaacaggcatatagtcaggtgcaagcgtcggttgcaattcgatcgatatcttcgacatcccgaaataagactccgacttaatctgatacacatccgacatagactgtatctctctttctatcggttcggtaatcagtttttccacttcaaaaggagttgctcccggatattgcgtaaccaacacagcctgtttgattacaaagggggcgtcctcctttttcggcagtttgaagaaagagtatataccgccaatcagcatcacagccagaaagaagtatataatcttactattctctaaggaatattttggaatattcattgtttatcttcttaatctgttaatacttttacttgttgtccgtctacaaggcgggttgctccggcagtgacgacacgttctccggctttcaatccttgcagaatgatcacgttgtctttaccaaccagttctcttaccgtaatcttgcggcgttcaacctgttgggtttgtggattaaagacaaaaacgaacttatcgctactgttcgcttcgtcggcaacaatagcagacaggggtattaatacagctccttcgttgaaactctggctttcgatattcagtacaacgcggcaagagaaacctacggctaccttatacttattgagatcgaatgcaggatcgtcgatatacaggaatacaggaacaccggaaccgtcgggagacgcttccacatattcttttactttagccttgaaacggagacctttatagttgtcaaactccacatagatcgtataaggagtcgagaaataggtaatgttcgtttccggcattgtaaactggatttgcagtttattgggattgatcaggcagacaataccctgccccatctgtaccttctgataattctctacatacttcttctggataaaaccgtcaaagggagcacgaagcttggtttgctccaatgtattctgagagttttcaaatgcagcctgggcattggaataagaagcttttgtcgtttcatattcctgctgggagatcgcttgcttcgccagcagtctttcagcacgttgcaactgggcttgtgcagtttggaaggaagccttctttgcttcaaaatcccacttgaaatcctgagggtccatttctgctactatttgtccggtacgtactttctgcccttcttccacgttcagggagatcaatggtccggacattttaaacgccaggtcactgaactggtcaggagatactacaccactgaacgatttctccaccacatttaatgatactacttcagtcaactttaccggacgaggcccatgctctttcaccggcggttggctacaagacatcaatgctgccaatacaaaaacgggaattaatttaccattcatgataacttgcatttacttatttagttatttgttaattatatgctaatacaaagtcatataatactatgtgttaagtcatagcattacaacattcatttttttataattgttcggatattacctacctttttatcagcggaataccatttgcttgtacataattaaaaggaccaactgtcccagtcaatttttgcttccattactttttcctgttcatcaggaacggccgggaagaaatctattcccgttactttctctacactatcaacagggattgccatggatctcaatgctgtattcttatagtccctgttctcaaaaataaatccgatagccttatactcatcgccggaaacataacaaatcactttgtaaaatgcaccgggtactcctatcctgttctttcccatacgcttcatgtcgtctgtcataacaggaccggtagcaatcaataaagctccgtaatcgttcgcccacatccggcttaattcttccagatctttccagattccacgattcaatgccggcttctgcggacaaatattactcagataaaacgattcgcgcattgctttagccgaccatttcatgtcacccgccggagccaaatggccacggtcgtagcccgtacgggtataatcatcgttggtagcagtagctccttttaccaacggatcaggaacgaacttgttcgaacgttccgtctttttactttttgcttcttcgggagtcaattcataggcaacccagtttgctattttgtaatcagaattatatgatacggtatatccttcatggcgaattacctgttcagaccgtttagcctgcaacttgggtatctctgcgtttgctgggattttgaaggtcgttgttttgggacggggaggctttattgaggatggctcatcttttttcttttgctcaggaaccggctttttcggagttgcaggcttcttctgctctttagcaactgttttttgctgttccttcacaactggttgttttccggttacaggatacagataatcatataaaaataaaacgcctatcagacaggcaagcagtatagaaatagcgacaaatacccgtttgacagccagaacaaacgatgatacctgttttttcttcttcctcgatttcgactttgttttactttttccttttaccatcgaccaatagcctcacattatccccggcaaaagtagataatgtgaggctaccaaacaatatataaatcttaaatctattcgtcaatattactataaaaagtgcccgtattaaaagggacactttaaattgtgggctccaggaccaactttataagcttttcctttgggcgaaatcactattgcagttgtttgttcgggtacctgaatttcaacaagaatattacgccccgatttccgtaaatctactttgatttcaccataatgagtcgctaccgtagctgacgcttctgtcaaagaacccatctggggctttacctggaaagttttaaatccgggcgaagtcggctctatgccacagactttctggctgagtagtgttaacggaccaccactccatgcatgattgatcgttccgccaccaaagccatcgactcctactccccagccttcaaacaaggtcgtatattccttataacctaacataccggcatatcgatcccgcatacgctgcaacgcaacatccggagccccaatatggaaaagagcctccagtacatatttttccatatacggactggcatgatactctttcttcagcagtttcaatataaaaggatatttatctttcgaggccaaaccggaaaggacagccattgcctgtgcccggtcgtcattctcaccataataaccgggagaacgataggctgttcctgtccagaacttcgtattgaaacatttctcaatgctatacatcatacggccgatctcatcggcatcggccttcttcccaagttgaagggcaaaaactttttctgctttcagtgcgagatagtaccagcaattggtcagtactcccatgtctatctgttcaccccagtcgccccagctccattctccgctacgttcaacaggcaggccgcttttgtcgaccttccaggtttcgtgcaggtaacggtgcagacggtcgtagatagccggaatgaaagtactgtcgccgctataataatattgggtataaaaaccgtaccaaccgacagaagccagtatctgtaaaggtagttccttcgaccagttaccggcaggaaccggagcaaacagcgaaccatcggcacgctgccagttcatcaactcatggataccctttacggccaattgatgagaagaggtagacaaagcatagaaagcttcacccagttcgttcacttcatctccccaccactgagcacgctcacgttcgggacaatccatatagttgtcgcgcatcgttatatataatgtacgggctgaacgcttccatagttcattcaggaaaggatcgttacaccggaaagctccggcaaattcggtatcatatcccgtttcacggtatttcacatccaatacctttacaccttcagggataatgtaccacatttcgtggccgcttatccatccataactttcatattcctgtactcctttacgagtgatgtattcggcacgaatattttccggaccacctccccgatagttatcagtctgcatatggatcgtcttgccttcggatgcttccactttcagatagggtgtgaactgacaattgtaaggcaggcggcagaacaaagtatcaccctttgccgactgccgaacatttggatatgctttcaaaccaaaatctttaaacatcggtatcggacgttccaccagcttacccaatggagcctttcctactacacacgcaatttctgcacccgggaaaccaccgttaaaaccaggccggttccaaccatccattgctatccgggcatcaaaacggatattactttccgacaagcgataattcgggaaaggagcttccgtattttgataagcatcataaacggaacatgcccaactcttatccgaaataatctctactccgggtgcaatggcttcaaacaataaagcagccattccactgttgacatggctgaaaccattctttccgaaatgccacaccaaaacagcaagcgtgttctctcctgaaacaagataaggagcaatctccaccgaatcataataggtatcgtagggagaaggaccacgtttcaaaccgccttcaaaaacaaccatacgtccgttgatccacagccagtatttactgtcggcagcgatatgggctgtcagagtagtcggtacttcatctatagatacggtcttacgataagctaaccaggtgttgcttgcactttgacatcgttctgtgttgatccattgtgctttccagtcgttttttgtctctgctgaagcgaaaataccgatacatgcgagtaacagaagatattttttcatctcattgcgatttaaggtatatactatttactattttccagaattacccgtacacccgtcggagcttttatatcgctctttatcttgccgtccgtccctttttcatggcggatagtaatgattccttcaggtgtaggaaaagtaccttccacccaatccaaatctcccagatacggagtgatacgaactacacgacaaccgggttccacaacctgtacacccagtacatattcgctcagccaagctgtcggaccggaagcccagccatgacacaggctatgacggaagcctttataacaatagtcgccataatcgccatgaatgtctttcttcccttccggaacgagttcgtcaatagctgctgcatcaggcaaccaggccatattaaaatcttcccagaacgtagtagcccccaagtcgatcatcgctccccaatactgacggatcacatctatcgcaccctgatagttgccggcagttgccatggcacgcaacatataataaccatagaaagtagaaaagccttgtgctccgtttaccgaaagatattttttgtcggcctcttccggtttcatcagtccggctaatgccagtaaagctgctgcctgtttagaacccggtgcgtccggtgctattttcgacttaagtagtgtttttgttacctgaggggcaacctttatcattctttttgctgtttccaggcattcggtagccagggtttcatcacctaacacagtacacaattcgccaccggctttcatcgcttgcagaaccaatgcctgtaaaccggcattgattgcttccggattctcactggaaggccagtccagaaaacgccatccgtccagcttctcatgcccgctggcatctactttcgacagcaactgacgtaataggccactcagataaggttgttgttctttcagataggttttgtcgccctggtaataataccaatcgcgctggatcagtaaccaccagatcgaataagcactgatcccgttcatccagtcgggaagcggagttgcttcacggatcaggtccaggcttttgggaacgacctcattatagccgaaaacggaattgatcgtcatgacttccgggtgcatatctcccagccagaccaggcggtcgcgcttgatgccatcccacagatattcctgcatattcagatggacggtgtaagccccggtctgccagatcttgttcaaccgctcgtcgctgcttcggaatgatcctttatatggaatatcgcgataagtggaaatagcacgtacctcttttaaatgcaattcggtagagtcgtcgataagatcgatacgggcaaagcggaagccggaattacctatttccattactcccatccaggggagtgaaacgatacagtcacgcatggcatggtcgttactcgccccattctttccatcgatctcacacatggcttcgcttacagattctcccaggcggatacgcaccgaaatgggtttatgatccgggaaaccgcccgttacaagttggatacctccttgcagttccttgccaaaatcaaacagaatagcgggatgtttccctttcgtactcttcaatttacagattgtacgatccaccaatccagcctgtccgttacccggtaaaagcaaattatcggcatcttgtatttgttcgctgtgttgctgccatacgatacgcgttggagaaagatattcacgtatacggctgtcccgctgtcgggctgttgccgacagggtacaaaataaagtaaagagtataagtatctttttcatggtctttttcacaaactagtctgaataatcggaagatgtgtcagaaacgtatttccgacacaccgtcttcatatcatttatatttataatccaaaagcaggaacgagatcgtccagttgctggtcggtcattcctaccggttcatatccggccatacgggcactgatatagatttgggctgatttactcagcgtatcgatagcatcgaagcattcgatcaggtcttcacccactgccagtatcccgtgtttttcccaaaatacgacatcatgcttttcgagttgccggatcgtggcatgcgccaattcaatcgttccggggatttcataagggacaatccctactcctttcggcacgataatacgacattcggggatcatactccacaaagtacgggtcagcactttcgattcgaggaaaggtttgcaatgcgtcataccgatcagttcggtcggatgggtatgcagaacgactctgttgtcgcgtcccaacgaacgaagataattatgcatcatcaggtgagaaggtaattcagatgttggcctgacaggttgttcggcaatgatatcataacttttcccatcggctgctatacgtatcagcgcaccgttggcaaagggatcttgtgccacataacgcatgcgtttacctgttccggtaacataaaacacatttccaccgagggaggccatcgcttcctgcaattcgatagccggggccagtgccggtaataccatttcgtcgtcagtcagcaaaccggtcaagtttacagatatattcccgccgttacgttcggcccatccttttgtccaaagataaccggccacttcggcgatacgtcctatttcagccatcagagggctgttgtttctaattgttgtcattttttatttgatgtaatttaaaaattgtattaaaattattgttcaattctctgtcgatgcagatttttccgggttatacttcgttgtcaggccgtccaaggcttccggagttatgaaaacgatcgttttttagctccggagggattggatgtattgccaacgatcgtttttgccactcacaagctcttggaagtatccccaacgattgtttttatcactcacaaggcctcggaagtatagccaacgattgtttttgccactcacaaggcctcagaagtattgccaacgatcatttttgccactcacaagccttcgggagtattgccaacgatcgtttttgttatttattatcctaataagttgggtaataacaatgaaaatatcaggatacacatcccggatactaaaacaataatcgttttcctgctgacacctttccattcgttcagtacgattccccacacattactgaatatgacattcagcgacatcaggatactccacgaaaaagcaagcatgacaggtgagtctgcaaaatagcttttccccatccccaatccgaagaactgcgaataccacaggacaccggccagtgcacaaaataagacattattcagtaatatctttcctgtaacggagaaataatcctttcccgatttatttttaatattctgaaatatacagtaaacagcatttgtcaggaagccacccattgtaaccaacaggatcacaggattcaaagcaaacaattcgctggctccagaggtctttgccttttccagtatcggagttccggattcaagccccaggttaaaacaggcgctcatcacacccgccaatagcgcaaccagcaatccttttgtcagggcaaagtctttcactgcggccttcttctcctcatctgtcatatttcgggctcgcaggctaccggcatagccgatcactgcgatgccagccaacgttacgcaaacacccagtaaaagaatcaatccgtcaccatgaaataaatccgttcctccgaatactgccggaaaaagcgtaccgaaaccggcacaggttcccaaggcaatactttgtcccaaggcaattcccagatagcgcatgctaagaccgaaggtcaaacctccgactccccacagcattccgtagatcagagcaccggtactacctccggcgctccataactctgccaggctctgtccttccggaatagccagctgtgcccccagatacggaaaaacgagccaggcaaaaatgccctgtatcagccagaaactttcccagctccagttcttcaccttattgatcggcacatacgaactgctttgcccgaaactgccgacggcaataattaataaacctattaatatattcatattactaccgcttgcttgttacctgcgcttcatatttttctatctcaccgatatagtcttcacctacgggtacatcgtttttcaggcagaacatatcccatacggcattccatggaaggctctttaattcttcctgcagagccagacgttcaaataatttatcttcggcttcatactgttgcaacgtggcagacggttcaagcaaggcttgcaagaatgctttttgagtggcacggcatccgatcacataagcaccgatgcggttaatggtcgcatcaaaataatcgagaccgatgtgtacacgatccagtgcattacaacggattatttcacgggaaagatccaacaggtcgtcactcagaatgaccacatgatcactgtcccaacggatcgggcggcttacatgaagcatgatctccggagtgaataacagcatcgacgagatcttatcggcaatactttccgtcaaatggaaatggccggtatccaacgttacgatcttgttgttcttcgcgccataccccaggtagaaatcataagagcctactgtataactttccagaccgataccgaacagtttggcttcgatacagtctttcatatgtttgtaatcggttgtaaatatctcgtccaatgaatctttcagcaactgacgatatttgatacggctggccggcacctctttcgaaccgtcatgtatccacaggttcatcatacaaggatcattttggaattcccccatcgcttcactgacagcacggcaacgtttcgtatgttcgatccagaaatcccggatcgatttgtccggattagccaatgtcaggttcccgctcttcggatgagagaaagaagtagaattaaaatcgagtttcatattgttttctttcccccattccatccaactcaggaaatgagccggctccacttcatcacggtctactttctttccgccgaagtcaccgtatatctcatgcaggttcaatcgatgggtaccggggataaacgagttcgctttcaacacatcggcacgcaactcgtctatattccgggctttaccgggataattacctgtcacctgtatacctcccgaaagcgatccatccgggttttcaaagcccgtcacatcatccgcctgccagcaatgaagcgacaggctgattttttgcaatttctccaatgcactgtttacatcgacattcaaggctgcataacgttctgccgccaaatcaaaagcctgttttacattcttttctgtgttcatgatattcttctttttatcgttttactatttcaatatatctttcatagacttctttccagattatttcttcctgtggcaggaatgtttccgtatgaacggatccggctatcaaccggcgcatttcccaacgggtggagacaatacctgccgagcgtgcctgtatcatcgcatttccgatagccgtcgcttccgacggcccggctattaccggcataccgattgcattcgctgtaaattggtttaataaagcattttttgaacctccccctatcacatgcagacagtcgatacggaaaggagccatctctttcagcatacggatcacttcattataacgaagtgccagactctcgaagatacaacggataaactcggcatccgttaccggtattggttgccctgtttcttcacaatactctacaatagctttagtcatgcaggatggattggcaaaacggggatcatccggattaacgaaacgtacaaaaggcactgcctgcccggccatctgtacgatctccggatacgtataagtacgaccggccttttcccattccttccggcattgttccaacagccacatagccgtaatattcttcagaaaccggatcgtaccttcaataccaccttcgttcgtgaaattattttcgtatgattcttttgtaattataggtttttccgactcgatccccatcaagctccaggtaccactgcttaaataagcaaaatgtatatcctgagcaggaacagcagctactgccgatgccgtatcgtgacctgccacagcaatcacaggtactttaccgacaccggtctcttcagccagtgcatctgtcaattcgcctacaagtgttccgggtaataccacctgccgcacgatagaaggcgatacccccgcggcttccagcaaagaggcttcaaattgtcgggtaaccgggttcaatagctgggatgtggaagcatcggtatattcacagactttgttacccgttaatagataagacaatagatcaggtataaaaagtatttctttagcatttttcaaaggtgcaaattcctcctgtcgggcagaatagagttgaaaaagactattgaagttcataatttgaataccggtcagacgatacacttcttcacgcgaaacccgctgaaagtatttctccggtatcccttccgtatacgggtcacgataggcccggggtaatcccaataaagtaccgtccggggccagataaccaaaatcgactccccaggtgtcgataccgatcgagtcgggtatgatctgttgctgtgcacaaagcgaaagacttttctttagttcttcatacagattgtatatattccaatagtattttccatgtaattcgagcaggttatttgggaaacgatgaatctcccgcatttcaaatttgccattaattagtactaccaagacagctcgtccgctggttgcacctatatcaaacgctaaaaaggtatgtttcttcatgatataacaaagttatttgtttattgatagcaaaagtatatggttaattactatatttgcttacgaaaatgattttaaacctttcaattctgacatgaataaacacatcagcgaccaactgcgttatcttaccatcggaacatcagacgaagactggggaattgttgttaccaccattggttatcaatttatcccacctaaaagtcagtacccgttatcctgccatccggaaagttataatttcaaaccgcagacaggacgtatcctgaacgaatatcagcttgtttatataacgaagggaagtggttacttctcttcccaatcctgcaagatgcagaaaataaatgcaggaaccatgatcttgctctttcccggagaatggcatagctattatccggacaaagacagcggatggaatgaatattgggtcggtttccggggaatacatatagacaaacgagtagagaaacgtttcttcacgaaagaagaaccgcttcacaaaataggattaagtgcaactattgtaggattatatgaagatatattaaagtttgcctcacaagaaaaatcaggatatcagcagatgatatcgagcatcgtacttcatatattaggaacggtttattataaaaagaagaatagttcgttcacgaatacatatgtagtagacaagatcaacgaagctcgtatcctgatgaaagagcagatagagaatccgatgtcaccagaagagatcgcctcacaattaggattaggttattcctggttccgccggatgttcaaagaatatacaggcgtttcacccgcccagtatcagttgcagcaaaaattgctgagagcaaaagaacttcttacggggagcaatctgaatatatcggagatcgcttataacctgaagtttgagaatgccggtcagttctccaccttcttcaaaaagaaagagggcgttacgccctccgagttcagggagagggcacattagatttgtattaatgattcgttccttcaaagaggtcgtgatcttccttcttctgcgaagattttgctttaaagttattgaaggtgtaacttaacgtcagagtaataagcggataattcggacggatgcgagtaatcgattgcaagtcggatgtggtgatcttacttacataacgggccgagttgaaaacgtcacgaaaaaccagtgtagccgaaagtttacgtttcatcaactgctgacggaccgccaggttgacataccagaaagcatccgtacgtccctgagtagtaacagaaggccccacaaagtttccatccaattggacacgggtggatttacccagatcaaaagcattgttccaaataatatcgtagttggtacttttttcgttcgtgccgttcaacttatactggttctttactttataatgatacaggctaccgttcagattcacattccaccaatgggtcaactgcacctggccgctcagttccagcccggttgaataatcgtgaccgacattggccatagagtcgagcgttacacctgcttcataagggacacgcagacgttcgatcttatctttacggctacgatggaacactgtggcggaaacggtatgttcgcctatattcttcttatagttgagttcaaaggagttaatgtattcggaacggatatccggattaccgatctccgcagagtagtaatcgcgataagtaatataaggttccataaagaaaagctccggtcgcgtgatacggcgtgaataggaagccatcagcttatgatctttcgggaaagtatatcctaaatgaactgaagggaagaattcgaacttattatattcacgatccttgccggggatagaactacgaagcacacggtgtgtatgttcccctcttacccctgcctgaaaatcgaatgatttataactatcccccacaatagcatagatcgaattgatcccgtgctggaaatagaaggtattataaatatcatcgcgccagtagaattcttttttctccggactccagaactgcatgctgtaatcgccatcctccagataagaaaaatattggtaaccggcttcgatatgtccggtcttgctatacggatagatgtaatcaaggttcccacgcaccgtccaacgatgttcgtcttcccaggcacggtgaccttgttcacgttcattctttttattgaacaggtcgctctggaaatattccatggcatcgccaccatatttgaggtaaaagctgccggtcagttggtgacctttatcattgaatttatgatcgaagcctacgtttccctggaaatatgtttcgtggagatcgtaatcgtcgcgactgtaataatcaccgttagcaaaaggtttatcatcgactacacgttcttcggtataatccaggtctcctttgcgggtacgtccgccgtagccaccttccagatctacattgaaggttgtgttaggtaatgtatacatccagccggctttcagagaatagttgaagttattactttcgcgtggaccgttggaatgtgatgtcgttgctgtatcggctacgatcgttgtcttttcctgatcgaaatggcttttacgcaaacggtcggtccatccacctccgaaatacaaacgggaagctttgttctgctgggttagtaagaagtctaccccccgggagagaaaagtacttccggtcaggttgaccataccgctgaacccatgttgtgcatgcttctttgtaataatattgatgatacccacatcgcctcccgtatcatgccgcgcagagggcgttgtgatgatctctatgttttcaatatgtccggaaggtatttgttccaaagcctgcgtaccactgaatacacttggctttccgtccacataaactgtaaatcctgtgcttccgcggaaggatacttccccttctgcatctacacggatagacggtgtattctccaagatatcgacagccgtaccgccgcttgccagcatattcgacgaagcttcgatcactttcttatccagtttgtatattacctgcttcttttgggctaccacttcaacctctgccaggcctacttccagcggattcatggcaatcgtacccagatcgaccactgaagacgaagaggataagacaatatccggccgggtaaacaggtcgtaacctaccagacggatcatcaggctatattcaccgttttttacttctgcaattccaaagctaccatccatatcgggtaaagcatggaacacaggattagtatctcctttcttaaaaagaagaacatctgcaaaatctaatggcttattggtcccggcatccacaatttttcccttaatacgggatatcggagcggcagttgcagacagagaaacacacaataaggtcacaatgagataaaaacacttcttcatttcttcacatcagtcaattgttaacaagtcacgaagatagtattttcatcacttctttgcaattattcaggctatttctctaataaatgcagatatttgccatatccctcctcttccattttatctttgggaataaaccgcagggaagcactattaatgcaataacgtaatccacccagttcggacggaccatcggtaaacacatgtcccaagtgagcatcacctgtatgactgcgcacttctacccgtgtcattccatgggatttatcgaggttttcctttatcaaattcttgtcgattggtttagaaaagctgggccaaccgcaaccggaatcgaatttatcggcagatataaacaaaggttctcctgtggtaatatcgacataaataccttcgcggaattcattccaatattcgttacggaaaggatgttcggttgcgttcttttgggttacggcatactgctcgtccgataatgtcttacgcaaagtggcatcatccggtttctggtaagtaacccctttgactgcatggacattcgcttttttggcatactcaaacaatgacggatcaatatgacaatatcctcccggatttttatccaagtaatcctgatgatatccctctgctttatagaaattagacaaaggctccacttcgactacaatcggtttcttatagtttacggacaaatcttttattacctgcactattattggcagattatttttgtcagtatagtaaattccagtacggtattgtgtacctcgatcacctccttggcgattcaggctggtcggatcgatcgtcttaaaatagaggtctatcagaagtgcaaggtctacttcctgtggatcataacttacttttacggtttcggcaaaacctgtatcacctgtacaaacttgctgataggtcggatttgtcgtatgaccgttggcataacccacttctgtacttttcacaccgttgatctgtttcatgaaatgctctgtgccccagaaacaacctcctgcaaagtatatttcacttagattcttcattgacatatcattttgtttatttgattttttacttgtttcattttgtgcattacacataaatacaccacttatcattaatactagagctataactacattcttcataaatcttgaatatatatgatttgtattcctattctctgaaaagaatgttacacacaaatataaaacaaaaattagccccgaaaggttaacaatccccggatatctgataatttaaaatagataaaatgataggaataaaagaaattacgcggagagagcgggattcgaacccgcgaaaccctttaggggtttacacgctttccaggcgtgcctcttcaaccactcgagcatctctccttttgggaaggttggagaaggacatacagccctccataaaataaaaaagcagcttttatgctgctttgcggagagatagggattcgaaccccaggaacctctcggttcaacggttttcaagaccgccgcaatcgaccactctgccatctctccaataaatcaaaattaacgccaaaaccttttccagtcttgcttttcaatgccttggcctctcttgtttacgggtgcaaaagtagagaaaagaataatacgttccaaatatttaggaactattttctatatttttttctttttcaattgatacaaagcttcctcatatcatttaagtttcttataatcttagtattataagttacagatcagttcgcgttgcttttcaaaaaatagtattcgttgtctttctccacttaccgaaatcataatagaagaacggatcagcgcacgtagccatttgcgtaacttatcgtaagtaccttcatcaagcgaagctaccgaactgagtataaaggtttttatcatacttatatgataatttttcacctgtacacaccaataactagtatcaaaattaacgctcgatatataaagaaaaactttatttccggtctcctcaaaatagccatgggtagctagtgcttccatttcattgagaagcctcaacaactcttctttcagcaatcttacttcttcaactgtaatcagatggatgctctgaaaataattgatatcattcaccaaataatgaaaaatcaaaggatcaagtatgtagtaagtattccggatgtatctcgactcgcctacccctgccaactgtattccttcaaaacgttccgttacatcaatgtcctgaaaacgttttgactttccgggacctccacactgatacatccacttgaaaagataaaaacgggagatatacttatatttcatgtagagttgttgcggaaggatattcgtacaatcgattagttcagattgctcatcctcacgtgccaaaccaagtatatcaatatattgctcaagcatttcgtaatcgatatcgaccggatttacaaagtctaccagttttaattgaaacggtttgctttttgcagttaccgtaccgatcagattatctaaagaaattccgaattcattcgctattgtgacaatctctgcaaatgtaaaagcgacctctcctcttaaacgcctgtaaactgcctccttttcgatacacaacaaatcgactagtgtattcacaaggactgttctctgggggattttctctctgaccgcattgagaagattatcatacaaaagatcctttttcatgccacagaattataagttttgatattaatagactcaccgttttctcacgcaaagataaataaggaacttataaaaatgactcttaataacctgacaataggacaattgccatctaaaaaaagactaataaaacaagtagcctttgaatttgggcgaccctataaaatggggttccttcgttaataatacataaccctcttcacataaaagtttataaagtatttataattacatgctgctcctcaaatttgcaactatgatcctattgggaatcttttcccgtattacattcaggatagtatcagcatcattttatctatatcaaaacaactaaaagattatagtttatcatttttaatgacagaaatcgtaacattttcaagaaggctccctaattcatcaaaataggcggtaaataaattcctacttttttcagtttgctatttatatatacttaaatacttgctatcaggcgtcttttatcaaaaagatcgcaaagattatcgcgaaccagtaattataaagcggtaaaaaggggatgctgctttaaagggctgtccgttttgataacaggttgtgaaatctacaaaacggcggccctttttctttcatagattaaaagacattgtttatcttcgtaaactaaaattatacaacacatgaatatcaataaaatatatctattcatattctcactgtctctcctactttcttcctgtatcaaagagaatggagacgaaagctccattaactacgtcaatatcaacgaccaagtccctccatttgccgtagaggatgcccaagaggaaacattcaactctaaacagtttctcggcaaagagtctttactggtgtttttcggaacatattgccctgactgcaaaaaggtattgccagtgatagaagaagtatggaaagaactaaaagacgaccctaaatttttattggtaacgatctcacgtgaagaaccaaccgaaaccgtatccagatactggaaagacaatcaatttacaatgcctttctatatagatcctacccatggtgacgttttctctctctttgccaacaatacaatcccgcgaatctatgttattaatccggataacaaagttgtctggatgtctgttgaatctctggatatttccgccaaagagttgattcagaagattaaaggatcaaaatagaagagtaaccgtataaaaacaaaaatgtccgtaaaattaatctctacaattaattttacggacaactttttataagaatggtgcgtagaatgagactcgaactcacacgccgtaaccggcactaccccctcaaagtagcgtgtataccaatttcaccacctacgcgaatggtgcccagaacaggactcgaacctgcacgccttgcgacacacgcacctgaaacgtgcgcgtctaccaattccgccacctgggcctttccattatataaaaaaggcggcctcttaccgctcttattatctgagagcgaaagacgggattcgaacccgcgaccctaaccttggcaaggttatgctctaccaactgagctactttcgcgataacgggtgcaaagatataggtatttttttattttccaaaaccggaagatactttttttatactaatttttccttcttcacccgttcaaaatcctatcttattttaatacagcaacttccagttgaaaaaaaaatcagatacaggaaaccaattcactgaacaaagttgtcataacagctgcagccttgttcgctgcaacgattacgtcagctccgtcattcacaaaatcgtctgcaaaatgatatccttcattcgtgataaccgacattccaaatactcttaacccggcgtggcgcgctacaataacttcagggaccgtactcataccgatggcatcccctcctacgcgaccataaaaagcatattcggaaggagtctcaaaagacggaccggttaatccgacatatactccttttttcaaaggaatggcgtgtgaatcggcaatctcctccaccaaacggacaaattcgcgatcataagcacgggtcatatccggaaaacgggttccaaacagctcattattcggaccgatcaacgggttcggcatcatattaatatggtcacgaatgatcatcagatcacccaccttgaaagtattgtttattccaccggcagcattcgacaccaacagattcttaatacccaacaacttcattacacgaaccggaaaagtcacctgctgcatggaatagccttcataataatggaagcgtccctgcatggcaagtacctgctttccgcctaacttaccacagataaagtttcctttatgtcctgcagcagtcgaatgcatgaaatgagggatttcggcataaggaataacaatagcctcctctatccggtcggctaaagaccctaatccactacccagaataatagctgtttccggattcccggtaatacgtgcagctataaacgctgccgcttcctgatattgttcgttcgtatagttcataatatttctattatcgacacattgccatattgccgtatcacattatttatcgtttcattaaatcataggcagtttgagccgcacgttctatgatctcatcttcaccgggtactttcttgttttgcatcaggacttttccattacagataaccgtatcgatacaattaccattggctgcatacaccaggtttgagataaagttgaagttcggagtaaatgcaggtatattcaaatcgaccaaagataaatcggcaagataaccttctattatccgacctgctttaagacctgcaataacagcaccactttccgtggctgaatgaaagatatcaccggctgtaacagcttccggatctttccgccaggcctttcctaacaaagaggctaacttcatggcttcaaccatatccagattgttagaggaagaacaaccgtccgtccctagtccgactgtaattccggcattcagcatttcattgtacttgaagtgcatacctgatgccagcttcatattggaagccggattatgggcaactttaactccatgatctgccagcatccttatttcatcattatcgatataaataccgtgtgaaataagtagtttgggagataatacacccaatttatacagataacgtaccggcgtcagtccgaattgttttacagagttttccacttctccttccgtttccgccagatgcaactgaatcaaaacattatgttctgttgcaaaagcatgcacccactgtagtaattcaccggaaacagtataaatagcatgcggaccgacagaaaactgaacacgcttgctgtatctgtccatctcgtcataaagcttctggacggtctttttacttttctctgccagttccggttgaaagtggtcaaagcaggcactggaaataacgcctctgatacccatctcttctacagcctctgcggttgcatgaaacttatggtacatatcaaaaaaagtggttgtcccgctttttatcatttccagacaagccagtttggctccccaataaacatcctcttttgtcagcttggcttcgttaggccatatcttttcttccagccagggcatcagcggcatatcgtcaccaaagccacgaaacaaggtcattgcagcatgaccatgtgtattcacaaaaccgggaattacggctttacgacgaccgtctataacagtatcggctgttacaggaagatttgcgcctatctgtttgatatatttgttttctatataaatatcggtagcaattccattcagttcaacctctttaatcaatatattcatacaaatttcgctttcatattctttatcttctcatcgcggatacgtgccagcaagtctgctttcttatcacgttttactgccgcataagcacaactttcctttacttcgactacgccgagatcgtctttctccaaaccgcctttctggaaaagaaaaccgacaacatcctttttactcagcttgtcccgtttaccgcggttgatcgtcagtgtcacccattccgaacgaagaggtttcctagccttctccggcaggaaaaattcatccggttcacgggtgatatattcagggacagtttccacttcgttcaggatcataaaggcatttccttccgcattcatacgggccgttcgtccgtttcggtggataaacgcctcttcattgatcgggagatgataatgaataacatttttcacttccggaatatccagtccacgggaggccagatcggtggaaataaagacggaagcactgccattacggaaaagcgacaaagcccgttcgcgttccggctgttccataccaccgtggaaatattcattatccacccccatctcggtcaagtaattgctgacacgttccaccgactcacgctggttacagaacaccaaagccgattcgcctttcagttcgcccaaaagtttgtatagcgtttccagtttatccttgattggagattgtacgatacgcaaagtcaagcctttcgcttcctttacacctgtcaggaatgacaaacgtaccggtgccgtaataccggtaaaaggcggtatttcgacagcttccgttgccgaagtcaacaccctgcgacgcacgcccggaagatgtgccagaatgtctttcatctcatcctggaagcctaattccagagatttgtcgaactcatccagaatcaatgtccggacggtatccaaatcgatattaccccgttccagatggtcgaggattcgtcccggagttccgatcaatacagtcggcgcatgttccaggctcttcttttccgtccggatcggatgaccgccgtaacagcaattcaccttatatccggcacccagagaacggaataccgtctctatctgtaaagccagttcacgcgacggagcgatgataagcgcttgtatctttttctcctcgtcagtcaatgtagtaagcaaaggcagcaggaatgccagggttttacctgatcccgtcggactaagcaaaaccatatctttggttgtaccggcatcgagcacggcctgctgcatttcattcaacgcctcgatacctgtattcgataaggcacgggctacgatctcattttgtgtcatttatattctttataaaattcggcaaccgattcaatccctttatagaaaaagtccaacatgcaactctcgttaggagaatgaatagcgttctgttcgagcccgaagcccatcaggacggtctttatacctaatacctgctcgaaagtggagataataggaatacttcctccacggcgtacagccagcggcttctttccgaaagcaaccgtacaagctctctccgctgcctggtaagcaggcaggtcgatcggacaaacataaccctgtccaccgtgttttggtgtgacttttaccttaacacaagcaggagccacttggtttatataatcttcgaacagctgagatattttcgtatgatcctgatgcggaaccaaccggcaggaaactttagcataggctttcgatggcaacacggtcttgcttccttcttccgtataaccgccccagataccacagatgtcgaatgacggacggcaactgttcctttccaacgtcgaatatcctttttcaccgaacagggcatccacaccgatcgcggctttatatttttcttcattgaacgggatctgtgcaatcatctcccgttctgccggagaaacttcttctacatcatcataaaatccggggatcgtgatacgtccgtcggcatcgattatatctgccatcaatttgcataaaacattgatcgggttagctactgccccaccgaaatgaccggaatgcaaatcacgattaggacctgtcacttcgatttcccaatatgccaggccacgcaggccagttgtcaatgaaggtgtttcggcactgaccatgctggtatcggataccaggatcacatctgctttcaacaattccttatgttcgcggcagaaggtttccaagctgggagaaccgatctcttcttctccttcaaagataaacttcacattacatttcaataaatcgagtttcaacgcagtctcaaaacctttcacctgcatcatcgactggcctttatcatcatcggccccacgtgcccagatacgaccatcgcgtatttccggttcgaacggctggcttttccacaactccaacggttcggcaggcattacatcgtaatgagcataaacaagtacggtcggagcatccggtgaaataatcttttcaccataaaccaccggatttccttctgtgggcataactaccgctttgtccgcaccggaagacaacaacaactctgtccaccgttcggcacaagctttcatatccggtttatgttcgtgttttgcactgattgacggaatacggatcaagctgaacagctcttccaggaaacgatctttattggattctatatacgattttactgtcataaaactggagatttaattttaaatttaacgtttttatttagggttacaagtttacgaataaattacttaaatctaccttttattgtcctataaaatatatcagaatgttaactttccattcctatgtttactggaatctactgccaccaagtgcatggaacaggtttataaccccttgtattttatcaaattgatcctgcgcctgtactaattccgcatccaataaagacttttgtgcagtcaatacttccagataattcgtagaagaatattgcatcaataacttcgttttatgtacagcttcctgtaaagcaccaacctgctgcttcccgatctctatcctttgttgggcaacctgccactgcaccagagcatcgttcacttctttccctgcattcaaaacagattgttgaaatgaaagagaggcctcttcctgccgcgctttcgccactttcagattagcgatattcgtacctttattaaataatggttgtgtcaacgatcctacagcactcaataacaaactaccgggattcataatcacaccgctaccgttatttgtccatccggcagtaccggaaagcattatgttcggataaaaagcagagcgtgccgcattggttgaataaaaagcctgcatcaggttaaattccgcctgccgaatatcgggacgattagataaaagctgcaaaggaaccccaatctttagttcttccggaaacgactgttcctccagcgtcttccgttcaatcgtttgtggtgccatagccagtaaaacagacaaactattttccgtttcacggatacttttctgtatggatagaatagaagcttcgagtgccaaatgatttgcctttgcctgaaggatagcagtatcattcgattcccctgcccgtttcaatgcttccaaagtctttaccgtacgtgaccaactttccaatgtttctttattgattacaagttgtctgtccaacatcaacaaagtataataactattcgcgatggtagccaccaactgtgtctgtacagcctgttcatacgcacggcttccttcaagtgcagctttcgctcctcttttcgcattcgttactttaccgaaaacatctatttcccaacttgccgacaaagctaaattatacgtcttaccaggagcagagccatcgaagctgctaactccgccctccggattcaacgataaagaaggaagataggaaagacgggcattcatcaggacagcttcggcttccttcacccgcaaatgagcgatattcagatcggtattatactccaatcccctttcgatcaggttctgtaataaattatccgtaaaaagttctttccaggaaagagaagcgactgttgccgtatcttccactgtcatatcccgatacagtccgtccgtattaacctccggacgagaataaggtttatatatcctgcaacctgtcatcagacagattgcaagacttaaaataaataactgtttcatactcactttttctttcctatttcttctaattccgtttgtatagaccagtcggcatcccccttagaggtttgtatcggtctgactttctcctgtagatattgaaatacaataaaaagacccgggacaaggaataataaagccaacgttccgacaagcatgccgcctaccgcaccggacgccaacgaacggcttccgtttgcacctaccccatgcgccaccattaacggcaacaggccaaataccattgtcaaagccgtcatcaggatcggacgcaaacgaacttttgcagcagcgagagcagcctgcgtcagtgacattcctgcttcccgacgtttagtcgcatattccgtcagaagaatagcagtcttagccagcaatccgataagcatgattaatccggtctgcatataaatatcatttcccaatccaaacagctgggcaaacagaaagctgcctaataatccgcaaggcaccgaaagaataattgcgaacggaataagaaaactctcatataaagcacttaatatcaaataaaccaacaaaaggcagataccgaaaataataacgacattattagtcgtcttgctttcttcacgtgagatacctccgaattcatatccgtaattcttcggcaacacctgatccgccgtttctttaatggcctgtaatgcatctcccgaactgtaaccgtttgccggtgaaccgttgatcgagatcgaattatagaggttgaaacgcattaaatcctgcgggccatacgttttcgtcaacttcacaaactggctcagcggtgccatttcctcaccgacccttacataaagatggttcagcgactccggtgtgacacgatattcaggatctgcctggatcatcacacggtacaatttagagaaacggttgaagttggatacatatccaccgctataatagcctgaaagcgtttctaagacttcacccggtgaaattcctgattgttcgcattgggcggcgtcgatatctacccaatactgtggatagtttgtctcgaaagcagaataaacggcttcaatttcgggacgttggctaagtgcggccacaaaattatctgtcactttcttgaaagcgttcaaatcaccggcagtcttgtcctgtatgtaaagttcaaaaccgctacccataccataaccagggatcatcggtggcgtcatagcgaatatctgcgcatccggaacttcagtcgacaaaccataaatcttattcactacatcggctgcagactggccttcttcctttcgctcgtcccaatgtttgagcgaaagaaaatacatccccatggaaggtcccgaaccggaaaatgaataacctaccacattggcattgtattctacctcagggatccctttaagctgttcgttcatctgctccatcacccgttgagtctgaggcagagatgaacccggcttggagttcatgctgatcattacggttcccgtatcttcatctggaatcagtcctgtcttggtatgttgtaccagaaaaacaagtaaaacaagtgcagtcaccaatgtactccacatcagccaacgacgtttgacaaacaataatactccttgcacataacgtttggtcatcacgtcaaaagctgcattaaacgctttacggaaacgggcagcaaaattatcctttacatttcctgcttcatctatataaggagtcaataacaatgcacagagtgccggagacaatgtaaaagcattgattgccgaaataccgacggcaacagccattgttataccgaattgggtatagaatgcccccgaagttcctcccatcatagacacaggtataaatacagccataaagatcaaggtcgaggtaagaatagccgaagatactccttttattgcatcattcgttgccatataagaggactgatatcccacatcgaaccgcgcctggacagcctcgaccaccactatcgcatcatccaccaccgtcccaatggccaataccagagcaaacaatgtcaataggttgatcgagaacccggctaccgacataaaggcaaacgtaccgataatggaaacaaaaattgaaatagtcgggatcaacgtagaacgtatatcctgcaaaaagacatataccaccaggattaccagcaagatagcttccaacaacgtttttatcacctcatggatcgaagcatacaggaaacggttcgtgtcattcagtgttataaactccattcctttaggaagatcactgcttatctcttccagtgtggcatcgatttcattaatgataattgaagcattcgacccggcagtctgaaacaccattgccagtgcagccggatgaccattcacctccgttgcataattataagcctcatctcccagttcaatatcagcaacctcacgtaaccgtaacacatcgccccccggcaaagaacgtatcacaagattaccaaactcttccggcgtagagaaacgcccacgatacttcatggtgtactggtgggtattatcatgattctctccgaatgctcccgtagctgcttcgatattctgtttatccaatacagccgagatatctcccggaaccagtttatactgtgccatcttatccggtttgagccagatacgcatactgtaattggaaccgaattgcataacctgccctactccggcaatacgcttgatacgcggttccacattgatcttcatataattattgaggaactggcgatcgtaagcatcgtccggtgagtaaagagcaaaagtcttcaactcagcgttctgctgcttcatggtcgtgacaccgatcttagttacttcggcaggcagcaaactcaatgccgtagaaacacggttctgcacattcactgccgccatatctgcatcgcttccttgcttgaaaaagatattgagaaatacatcgccactatttgaagccgtggaagtgatatagttcatattctccaccccattaatcgcttcctccaacggaacaatgacacttttctgaacagtttcagcattggctcccggataattggtaaagacctggatcgtaggaggtgcaatatcgggatactgctcgacaggtagtgtaaacaaagaaataatacccatcagaacaattgttatggaaataacaatcgataagacgggacggtctataaaatatcttaggttcatacttttttattttattgtttttcggtttctttgacaagtatctccattccgtcttgcaacaatccgacaccttcgctgacaatccggtcgcccggctgaagacctgagcgaacaatatagtcagtaccgtcgttcagcttttctatctgtagctgaacagcggaaagttttccgttttcctgcactttgtaagcaaatactttatcctgtaattcataggtagcagactgaggaatgacaatcacatcatccattttataaggaataacgacattaccgatcccgccactgaataacatacggttttcgttcggaaatacgcttcgtaccgatactgttcccgtctgctggttgataaccccgctgatactttcgatatgtccgttttcttcatagatgcttccatcattcaactgcagttcgatcgacggcatctgctttatcgtttcgtccggcgaaccatactgccggatcaatgcccggagacgattttctgtcatagagaaatagacatacatttgtgaattgtccgatacagtggtcagcggttgagccatcgacggattaaccaaagcacctgtccggtaaggaagtatcccgacaataccatccgacggactttttacttctgtgtaggaaaggctgttacgggcattcacctcttgcgcccgagattgctccaatcctgcggtcgcaatagacagtgcattccgagcggtcgatagctcatattccgaaataacgttttcacggaacaattcctgtttgctatcgtaagtcagccgggctgtttccacttgtgcttgtgctgcatgtacatttgccgtcgctgttcttaaagcagcctggtaaggaaccggatcgataacaaaaagagtttcgcccttcttcactttttcgccttcctgaacacaaagccggaatatcgtacccgacacttgcggataaatttcaatatcctgtcgcccccggatagaggcagaataagcttctttgatttccgccggagcagacgtcacggttaatactggataagcctgatgaaactccccttcttgtttattcttacaagatatcagaaacataaagcagagaatggtaataattagaaataaatttttcatacggttactaatttgaacaatctttcattatctggaactatctccggtaacaactgatttaccggagcgcaaagatatagtttgtcgtaacctgatcacatatcataatcctgccatatcgggtacttttcaatacaaactaaagagggattctaaaaaaacatactatcttcgcggagaagatccgaataaaatatgacaaatataaaatacgctttacaccgaccaggaaacgaaaatgcagccggaataaccgacctgaaagaaagtataggacatccgttggatccaaactgttgcacaatcctgttatgtacggcggggatggctactgtctctaccaattttcaaaagcggataatgaaaaaaggagatgcagtctttatctttaccgatatagtattcgttacgatcgaagtttcagatacattttccgccctgtatgtttcgctttccgaagaagtgatggaagaagtcttttataaaattactcctacttcgttttggtattttatatatgaccacgttattctccatctatcggaaaatcaatttatgctactgcatacgtggtatcagcaaacaaaatggattattgacgaatgtgcacaagaatataaactgacgctgttacgtaacaacattcacagcctttttatggctatcgacagtgaagcgaaagaaaaaaatataggaatcaacgatcactacaaaagagatcagacatgggctatcctgggaaagttcgccagtctgttagctgagcattgccatcaacaccgggaagtaagtttttatgcagacaaactctgtataacacctgattatctttacaaattagcttataaaggaatagagcaaagccccaaagagataatcgaacaaatgatcatcgtagagatcaaaacttatctttccaatactaatttgtctattaaaagcatcgcagctgaaatgaatttcgaagatccgtcatatatgtgccgtttcttccggagacataccggatcgtcaccgacagaataccggaatatctacttaaaataatactcacgaaataaaaccaataaaaatggaaacagaattaattttcgcgacaagagaagattttcaggagtggttaaagaattacggccagataagcgagggtgtctggttattattcgggaaaacaaaaacattaaaaacattatctgcagaagaggcgttggaagaagcattgtgtttcggttggatcgatgggctgattaattctatcgatgagcataaatacaaaaagtacttttccaaaagaaggaaaggaagtaaatggtcggaaaagaataaaaagattgtagaaaagcttatcaaagaaggaagaatgaccgggttcggaatgcaggccatcgaagaagccaaaagaagcggagaatgggaaaaggtacgggacagaaatgttaccgatactcaaaagtctgagtttgaatccttgataaaggactatgatctggcttatgctaattatcttacgacagcaaagtcgactcaaaataattttgtcggtttctactttgaagcaaaaagagaagacacccgcctgaaaagattagagaaaatagtcgggttattggagcagaacaaaaagttaatgtaaaaaggatattcttttcatgcattgatgtttggcatttacccgatatatatcgtacctttatcggaattaataaaccttgaattttacaatcatgaaagaatcgttcgattattcaaaagtaccttatgattttggtctgtgtgcagccgagaactgcccgaaagcaacaacctgtctacgccagatcgctttaaaacatgctccggaaaatataactttcctgcgaataatgaacccaaacacattaaagaagatgaaagggacgtgtaaactctaccgtcccaataccaaaatacagaatgcaataggattcatgcgtaccgtgaatgcactgactcttcgcgtggcagataccttccgactacggatgatttcctatctcggccggaaaaattactatctgaaacgtagaggaggatcacctttatcacctgccgaacaacaatatattgtcgctcttgccaaggagttgggagtagttctggaagagtatttcgacggatatgtagagtcgtataattggtgaagtaatcccatttctgtttcttcgcaaagatactccggtttcctgcggtggaaacgctagttccctcggcaggaaattacagtttcctcctaaggaaattacagttccctgccgagggaactgcagtttccaaagcaaggaactacgaggaaactgtaatagattatataacaaacagtaagcagattttactatgattacttttttaccatattaatcatccattttacgatttccggatcagtatgagagagaaacagactctttttttggtcaagcgtggtaatagcctgcatatcttcttctgataaggagaaatcaaacacttccatattctcaatcatacgctccttatgagtagatttcggaataaggattacatcccgttggatcagatagcgtaaagcaacctgtgcaaccgactttccatacttttcaccaattgttttcaatagttcattcgtaaagaagttatttttaccttctgcaaacggtccccatgacatgacccgggttccgtattcctccatgatcctctggggttctatttgctgattgaagacatgtgtttccacttggttgactgcaggttttatctcgcagaactctgccaggtcgacaaaacggtcaggataaaagttactcactccgatagcacgtgccttaccctctttattagcctcttccatagcacgataagtaccgtaataatctccaaaaggttggtgtatcaggagtagatcgacataatcactctgtagtttacgcaaagactcatcgatagacgcttttgccttttcatatccggcattggagatccaaaccttggttgttataaacaattcgttccgtggaataccacttttgctgattgcactccctaccccttcttcattaaaataggcttgtgccgtgtcgatagagcgataacctacgctcaaagcatccaatacacaacgttcacattcttcaggtgtcacctgataaacgccataacctaaaatcggcatttcaatgccattgtttaattttactgtcttcataatctttaaccgtttattgttttactgatacaaaagtatctgtttccaaataatcccgtattatataaataaccgaataacataccattattacagatttcaaattaatttatccaaaacaaccggaacaaaaaaacggactgccctaaaatcactttccaggcagtccttcttattgtaagaaaaaaataaaaacagtgggcctattctcgtccaccgcctaaagcccgatagagattaattagactttgtatctctgtgaaccgattggcggtgtgggtcagttgtgcacttaataaactttgccgggcagtcaacacttccaaataggttgtattgctatgctccatcaatagggaagtacttttcagggctacttccaacgaagcgatctgcttttccaggaggagactcttctctttactggtctggcaagctgtaagggcatcgttcacctcgcttccggcgttcaataacgattgctggaatgagagggcagcttcttcctgctgcgctttggctatacgatgttgggcgataatctccccgcgggcaaacagtggctgtgtaagcgaaccaactgccgatgcgaggaatttgccggggttgactatcatcgatccggcattgtttgtccatccggcgctaccactcagggttatcgaaggatagaaagcggaacgagcctgattggtgccgtaaaaggcagcttccaatgtgcgttcagccatacgtacatcagggcggttagccaacatctgtataggaataccggtagagatactttccgggaactgctgactttccaatactccacgctcgtaataccgtggagtctcagccagtaaaagggcaaggctgttttccacctgattgatttgctccttcaggtcaagaacagaagtttgcacctgataatacgtagcttccatctgtgatacggccgattcgttagtcaggccggccttcatcagggcacgggtagaagcgacagtctcctgccatgcttcttccgtctgccgggtgatgtaaagctgttcgtccaacatcaataatgtataataggtattggctatcccggctatcagctgcgtacgtacggcctgctgataatcctggctctgagcgtaaagtgctttcgcctgctgttttgcattacgcatacgtccgaaaatatcaagttcccagctggcagtgataggcaacgaataagtttgcgttgccttatgcccgtcgaagctgctcaccgatccttgcggagtaaaggcgaaagaagggaggaatgccaatttagccgacatcagcgtagcttcggcctcttctacgcggagttgtgccgactggtaatccgtattattctgcaatccttgttcgataagttgttgcagtttcgaatctgtaaagagctcgcgccagtccatattgccgaagctgacggtatcctctaccatcacttcctcgccatacaattggtcagggacagtggtggcaggtttatatttactgtatatgccgcaactactcagtagagcagatacagttgttagcagaattatctttttcatattccttctatttattgattattcaatagtaccacgttcagctgcactcttttcctgttccagcaaaacctgtacgtcggcttcttcttccatcggtttacggatcttctcctgcaaatattcgaaaatgacatagaacacaggaactacgaacaataatgccagtgttcctacagccataccgcctacgacacctgttcccaacgaactgttaccgttagctcctgcaccactggaaaacatcaacggaagcataccgaaaatcatcgtcaacactgtcatcagaataggacgcagacgaacctgggctgccgagtaggccgattctacaatacccattcctttgcggcgacgttctatcgcatactctgtaatcagaatagctgtctttgccaataaaccgatcaacatgatcacacctgtctgaagatagatgttattctccagtccgaatattctggcaaacaggaagctacctatcaacccgaacggtacggagaagataacggcaaacggaaccaggaagctctcataaagacaagccaggatcagatagataaggaatatacatatagcataaatgaaaacggtctgtgcaccactgttgccggcttcttcacgtgccataccgccgtattcgtaaccataacctgtcggtaaagtctgtgcagctacctcttcgataaccttttgcacttccccggatgaatagccttcagcgggattcacatttgccgtaatggaactatacaggttaaaacgattggctgattccggtccaagtactttcgtcagtgtcacaaactggcttatcggagccatttccgttccgctacgaacaaacatattgtccagcgactgttcgtccagtcgatattcgggagaagcctgcatcattacacgatatactttaccaaactggttgaagttggagatataagctcctccgcaatagctacccaaggcatcgagtacgctactgggagagatacctgcccgtttacatttggcggcatcgatatctactgttacctgtgggaagttcattgcataagaggtatatgccatagcaacttccggccgttggtttaatgctccgaggaactccatcaccgaattatagaataccgtcatatcaccgcctgtcttatcctgaagatttagttcaagggagttacccataccgtatcccgggatcatagcaggctggaaactgaatatctgtgcatctttgatctcatagaactgtgcgttaaggtgtgccgtgatagcatcggaactatgttcctctccttttcgctcgctccaatctttcaaacgtacaatgatcgtaccgtatgatgttccctgaccggatataagcccataacctgccacgcgggcataatgttctatctcaggtgttttgctcaggatattctccagtttattcattaccttattcgtttcatccagcgtgcttcccggtgaggtactgacatttaccatgataacgccctggtcttcctgcggtacaagcccggtcttggttgtactcatcagataaaccaatagaacaacggcagctgccaatgatgtccacaccatccaacgatgatgaataaagaacatgacaccttttttatattttcccagtactgcattgaatgaagcattataagcggcacgtacccgcccgttaatactcttctcactctttgttccatccgatgggcgcatcattatggcacataaagccggacaaagtgtcaaagccgaaatcatagaaatacctacggcggtggccatcgtaataccaaactgtgtatagaacacacccgatgttcctcccatgaacgtcacaggaataaatacggccataaatacacaggtacaggagacaatagccattgtcacatcccccattgcatctttcgtggcgagataggaggatttatatccggcatcaaacttagactgcacggcctccaccaccacaatagcatcatccaccaccgtaccgatggcaagcaccagggcaaatagtgtcaggatattgagactgaatcctgccgccaccaggcaagcaaacgttccgactaatgaaactataatagagatggacggaataagtgtactcttaaagtcttgcaagaagaaatacacgaccaggattactaaaaggatagcaatgacaagcgtctccaccacattatgaatagaggcgaaaaggaagtcgttcgaactcatcatcgttacaaattccgtaccttccggcagactttcccccattctctctatctgagcggttatctctttgttgacagcagttgcatttgatcctgcaacctggaaaatcataaacataacggcgggtttaccgtccatctcactgcggaagctatacattaatgtacctagttccacactggccacatctttcaggcgaagtacggaaccatcgctttgtgaacggatcactgtgttctgaaattcttcgacactcttcaggcgtccacggtatttcatggtgaactggaaaacattttccgaattttcccccaatgaaccggtgggtgcttcgatattctgttcgcccaatattgccgttacgtccgaagggacaaggccatattgcgccatccgctccggtttcaaccagatacgcatactataggtatctcccagttccattacatctccaacgccttctatacgtttaatctgtggaataacattgatatcaagataattggctaaaaaggtctggtcgtagcgttcatcgttacaaaccaaagctccgatctgcaggaaactggtctggcgtttttgtgtagccacaccgattcttgttacctctgccggtaaaagtccctgtgccttagatacacggttctgtacattgacagccgccatatcaggatcagttccttgcttaaaataaacctgtatgatcgctgaacctgcattagtggcagtagaagtgatatacatcatatcttctaccccattgatactctcttccaatggcatgacgacactattcatcacagcttcggcatcggctccggtataagaagcagtgacatataccgtaggaggtgcaatgtcgggatactgttccaccggcagcgtaaagagcgaaataagcccaatgaccaggatcagcacggagatggatatagccatcaccggccgttttataaatatgttacctttcatactctttttctccttgttttattttacgacagttccttcacgtatcaatccggcaccttccgatataatttcatcaccggctttcagtccactcaataccacatattcgcgtccgtcgttaatcccggataccgttatcagggtagagacagccttgccgtctacaactttatatacaatggttttatcctgcaaacgaacggtagctccctgcgggatcacgatgcagtctttataaatgctcggtatcactaccgtgcccgatgctccgctatgaagcaaccgcgattcattggggaataccacgcgtgctactaccgtacctgtctggcggtcgatcactccgctgatggattctataatacctttcttgtcataaaccgaattatcgttcagcttcaactccgcttccggcatgctcttcaacgcatcatccatactaccgtattcgcgtgtcagtgacaacaactgattttctgtcatagagaaataaacatacatatccgaattgtcgctgaccgtagtcaatgcttgcatcatgctgggactcaccaaagcaccggcacgataaggtaatgctcctacaacaccgtcgcagggactttttacctctgtataagagagattattacgcgcgctcagttcctgggcttccgcctgtgccaattgtgctttggctgtaagaaaagagttttccgctgtcttcaggctgaaatccgaaactaccttctgggcattcagctctttgttactgttgtaggtcagttcggcagtagccagtgcagcacgtgctgcttccacgttggcggtaaccgttttaagtgccgctttataaggcacctggtcgatgatgaaaagtaattgcccacgacgtactttttcaccttccgtcacataaagtttttcgatagtccccgatacctgtggatatatatcgatatcctgtcgcccacgtatcgtcgccgaataaggggtagaaagttctttatccgtaggcgccactttcatgattgcataagaggcttttacctgtgcatccggagcttgtttacaggatgccatccacactgtacaaccgacaatccctatcagccgtatccattttttgcttactttattcatatttttgctattaaaaactggagcaaatgtagacgaaagggacacagccgtagtgccccattttccctcaagaatgcttcattttccccttttcccatttcttaactcattttttacataccacaaagcgatatggaacactaaagacgtgaaatagaacatattacttatcccgttattcgccaaatttgcagaaacaaaaaagagaatatgaatatgaagaacatcaaaacagtcgacatagaagactttaaaacgaataaacatatcatcgattatgtggataatgactttgcaataataaacagcctggaagatgctcccaccggtaacgaaacggtaagactgggatgttttctactggctttttgcatagaaggatatattcaactcgatataaacaacagaacctttcagttgggagatggcgatttactactcggtcttcctaatactgttatcagccatacgatgataagccctaagaataagatcaggatggccggcttttctacccgcttcctgcaacgtattgttaaaatggagaaagttacctggaataccgccatctatatccataacaatccggtaaaacacgtaggtgaagataaaaatgagattttcaattgttacaagaatctaatcatcgagaaaataaacgatgctccccatcattatcatagggaagtaatgatgcatctgttttctgcacttttctgcgaaatgctgggagctctcggtaaggaagctcaccagaaagactccgaccaatcgaaggaaggactcaaacaggccgattatattcttaggaggttcattgaaaaactgtcggcagataacggtatgcaccgttcggtgtcctattttgccgattcgcttttttacagccccaaatacttgtcgaaggtcgttaagaacacatgtggcagaaccccgctggatctgatcaacgaaagtgctatcgaacatatcaaataccggttgaaacactcggacaaatctatcaaagagattgcggaggaattcaactttcccaatcagtctttcttcggaaagtatgtcaaggcacatctgggtatgcctccggctcgttatcgcgaagcaatagaggaatgaagtagattgattgcctccagaatattgttcgctttgagtttcgtcaggatatttttacggtgattattcactgtatatatgcttatattcaaccggtcggctatttctttactcagcagcccctgacggatcagtttcaatatttccatttctcttttcgtcaataacgaatcatcattatcaatcaccggaacagagatcaactccccgttcttcaaatccagtactgaatatttaaccgtttccaatggtgtttgatcgggagcaatatccattattcccattacaatccaggccttaccatttcggtcttgctgggtaacctgggtacggctgatcacatttatatatttaccacttgcattaagcatacgaaattgataaacattccggaaatcatttcttctttccacaggaagagaataaatgaaccggctatgcctgatctgcaattcaagcattctgtcacggtcatccggatgtattctttcttccaaaagatcaccctgcctttctatcgttcttatatgagattgattgtaaccaaaaatatcggcaaaactatctgatgcaaaatcgtattgttctttataaacgtctacagtaaacaggcaactatgactcatctctgccatctgtcgcaaagcctctctccttttcgtccacaaaccataatcaacatcctgatccgatatctgctgacgggcccacatttccccgagtgtttctttagatgatgacatatttatatacgcttgaaatatttctttccttttttaatcgatccgacacaaagttagcggatttttgtttgcctgcttcacccgcttaactaaatgtccttgttccgagcctgagtattaaagttgatttatcagtaatgtgtagcagagatatcaaccacctgtccgatcaccggaacgatcagctccaaagagttttctttagccatctctatttcgtttttcaacggttcgtcccaacggtgtgaggctaatgcgtatttggaatgatggacagtcacaaccttacgggctttcaaatctttggctgcctgtcccaaatactgaggcataatatggatattacgccatccctcattgtactgtccgttttccagaatagccagatcgatatccggataccggttgcctatttcttcaaaatgagtatcgtaaccgctgtcacctcccatatagactttatacgaaggagtttccagaagaaaagaagcccacaaagtcttattcgatgtcagtccgcgaccggaaaaatgacgggctggcaggcaacggaccgtaaagttctcatccggcaacgcactttcataccagtccagttcaataatattcctcttatcgaatccccaatattcaaaatgttcacccacacctaaaggacagattactttacggatacgatctttcagccggattaccgtctgataatccaaatgatcccaatggtcatgactaataaccagataatcgatatccggcatatcttccggtttatatatatccgttcctttaaaaggcttattgacaaaggaaaccggagaagccatacaaaacaccggatcgactaaaattcgtttaccggataattgaagcagataggaagaatggccgaaccagaccattacattcgaatcgtccgccaagtttttcaaatcggatttgatcgccggaaccggaacatccggattcagtccgtcaggctttaagaacaaataatcccacatgctgtgtaaaagacctttatcggaagtcattaacgtcgtcggatgtatattctgaaactctccatctttatattggggcgaacgctttatcctttccagtcgctccccctgcggcagacgtccgaaagccggtcgattgataaaggcgaccactgccactcccaaaacgatcactatacctattataagtcctgctaccatatatcctcttttttttattttcatatcaactcattttatataaaacaaaagtacatcccttttttcagaagtatggtatatggattactgatatttttacctttatcactgttcttatttgttgattttcgcttatctttgttaaatattaaaccttgaatcaaattaaataaggaatcatgaaagaatttgaagcagcactagtcagcgaaggaaagagtgaaagaataccggaagagtacaatttctttggtaaagtgatcggtgaatgggatcttgattggaacgaccacctcaacacacctactcccagacgcgtaaaaggagaatggatcttttcatgggtactcgacggaatggcagtacaagatgtctttattgttccgtcgcgaacagaaagattgatcgatatccaaccggacgcagcttacgggactactctcaggttatttaatccggaaaaatgtatttgggaaatcttctacggatgcccggaagaatgtgcccggctggaagcccggaaagaaggggacgaaattgtcctgacggagataacttcgcaaggtatgaaatggatattctctgatattacagacaattcttttacctggcgaagtactgccatcaacgaagacggggaatggatcactttagctaaagttttcgctatccgtaaaaagaaataaaacttaattctgcatccgatactcattcggagaagttcccacacactttttaaacaaacgggtaaagtgttgcggatacttaaagcctaattcataagcgatctcactgatggaacggctggtatcgagcactttctcttttgccatatcgataagatatagctggatttgctcctgcgcagatttacccgtttccttttttatcagatcacccagataatttgccgaaagatgtaactggtcggcacaatactgaacggatggcagtccgatattctgcggtttatccgactggaaatagtcgttcataatcttctcgaactttgccagtgtatccttattcgcattttcacgggtaataaactgacggtcgtaaaaacggacgcaatagtttaatagcagttcgatattcgaaacgatcagcattttactatgcttatctattccatgatgtagttccagttctatatttttcaggcaatcgattactatctgccgttcctgttccgaaagatgaagtgcctcatatacttcataagaaaagaaacggtaattcttaatgttacgaccgagagatgtaccacggatcaaatcaggatggaaaagcaacgcccatcctttcggctggatatattcacctttccgggcaacacctaccacttgccctggagctgtgaaaaccatcgtaccctcttgatagtcataataattacgtccgtattgcaggtcaccgcatttcacatccttcaaaaagactgagtaaaagccatatcttatacgtgcactctctacctgtagttcgcatttagaaaagtcgacaatactgatcagcggatgtagtgtttccagtcccatccggtcattatactgataaatgtgatccatttctctaatttccatcatatgctttctgttttgttttcacaaagttagatgttttttgcttcatttttcatctgtcacggcaaatcagtaataatggtatatataactgtaatatgtgtaattgttaacgggaaaaacaagaataattttgcatcagtaataatcaacaaaatattcagagaagtatatgttaagaaaaatcagactaactgtcgccgtcattttctttaccctgatcaccttgttgttcctcgacttcacggggacaatacatcagtggttcggttggatggcgaagatacaattccttccggcattgctggtggtgaatataggaatagtgatagggcttgttgtcctgacattactgttcggacggatctactgttcgattatttgtccgctgggggtatttcaggatgttgtttcatggatagccggaaaacaaaagaagagccgtttttcgtattcaccgtcggttagctggttgcgttatgggatacttgctatgtttatacttgcgatgattggaggtttcggttcgctattggctttgctggctccatacagtgcctatgggcggatcgcctccaacctgttcgcacctttctatcaatgggcaaacaatggactcgcctatctcgccgaacggatggatagctatgctttttatacggtagatgtttggatgaaaggaatagccactttcactatagccatcataacatttatcgtactgactatattggcgtggcgtaacggacgaacttactgcaataccatttgtccggtaggaaccattctcggcttccttgcccggtattcttacttcaaaccggttatcgataccgaaaaatgtaacggttgcggattatgtgcccggaattgtaaggctgcatgcatcgatacccaagaacaccggatcgattacagccgttgtgtaacttgtatggattgtatcgggaaatgtcgccggaatgccctgaaatatgtaccgggacaatcgctgcctaagaaaccctctgcttcacgccgtcactttttatcggcagctaccctgtttgccgtatcagccacattgaaggcgcaagtcaaacccgaaaagaatgtagatggcggtttagctccgatcgaagacaaacaaaagccggaacgccgcactcctatcacacctcccggatcattaagcgcacgaaacttcaccggtcattgtactgcctgccaattatgtgtatccgtttgtaccaaccaggtactgcgtccatccggtaaccttatgaccctgatgcaaccggaaatgtcctatgaactcggttattgtcggccggaatgtaccaaatgtgcagacgtatgtcctaccagtgccatacagccgatcagcgtagccgacaaatcagctattcagatcggacatgccgtatggatcaaagacctttgcgtagtcaataccgacggtgtcgattgcgggaactgtgcccgccattgtccgacagcagctatacagatggttcccaaagatcccgaagcactcgactcaccgaaaataccggttatcaataccgaacgttgtatcggttgcggggcctgcgaacatctttgtccctcccgtccgctgagtgccatctatgtggaaggacacgaaatgcaccggatcatttaatatacccgaaaatcatcaaaacaaagcatcatggaagaaaattacaaaaagaatatagaccgacggagattcctgaaagtattaggcggcagtacgctggcatcgacagcctcactttatagttgcaaaccggacagaaacgcttccttccggggaaacggttccggggatattcctgccgaaatgacctaccgcaccacgcccacaacaggcgataaagtatccttgttaggatatggctgtatgcgttggccgacagtttccaacagcagtgcaagggacagcagcgacgagatcgaccaggaaatggtcaatcgcctggtcgactacgccattgcacatggtatcaactatttcgacacatcgcctgcatactgtaaaggacgttcggagcatgccacaggtatcgctctcagccgttatccgcgtgatacctattatattgccaccaaattatccaacttcgcgccccagacatggagccgtgaaaactcgatggctatgtatcgtaactcaatgaaagagctgcaagtcgactatatcgactattacctgttgcacggtatcggtatgggaaacggcatggaggatttcgaaggacgttatataaataacggtatgctcgattttctgcttgaagaacgaaaagcaggccgcatccgcaacctgggtttctcttatcatggagatatcaaagtcttcgactacctcctctcccgtcaggacgaaattaaatgggactttgtccagatacagctcaactatgttgactggaaacatgcaaaagaggtcaacacccggaataccgatgctgaatatctatacggcgaattacagaaacggaacatccccgccatcatcatggaaccgttactgggaggccgtctctcgaacgtacacgaccatattgcagcgaaactgaaacagcgcagtcccgagtcgagtgtcgcatcatgggctttccgtttcgccggaacatttccgggtgtattgactgtgttaagcggaatgacttatatggaacatctgcaggataacctccgtacctattccccgttggaaccgctgacggataacgatctggcttttctggaagagactgccgtacaaatgctccgctatccaaccattccctgcaatgactgcaaatattgtatgccttgtccgtatggtctggatataccggaaatcctcttgcattacaaccgttgtatcaatgccggaaatattccggaaagccggcaggatgaaaattatgcgaaagcgcgtcgtgctttccttgtcggatacgaccgtagtgttccccggttacgccaggctaatcattgtgtcggctgtaaccagtgcaatccgcattgtccgcaaaacatcgatattccgaaagagttgttacgtatagataaatatacggaacagttgaaacaaaacttattatagcaaggatatatgagctaaaaagaaaaacaatttgaacgaataaagaacagggtattgtcttaaaactgctacttttgtccaataaagattatatatatgaaagtgttacttattaatggaagtccccggaaagaggggaatacatttctggctttgtcagaagtggcaacagctttggaacagaatggcgtcgaaacccgtatcatccaacttggcaataaagccgtacaaggttgcattgcctgtaacaagtgcaacgaattgggaagatgcgttttcaaagataaactgtatgaagagatacgtgaaaatcttcaggatatagatggattgatagtaggttctcccgtatattatgccgggcctaacggttcgctttgtgccatccttgacagagtattctattcctgttcggatatgcttacatacaaaccggcagccgcaattgcagtctgtcgacgtggcggagccagcgctaccatcgaccggctgaacaaatattttacgatcaacaacatgcctgtcgtctcttcgcaatactggaacatcatacacggccgcttgcccggcgaggctgtacaggatgccgaaggtttacaaatcatgcggacactcggtaagaatatggcctggctactgaaaaacataaaagccggggcacagccattgccggaaactgaagagcggcaaataacgaactttatcagataatattatctgtttttcctatacagggcagataatgagctattatctcaaatctccttatacatgcgtaaatattgtataggagtctgtcctgtatatttcctaaaatctttaataaaatggttcgtatcgctatacccattattgactgcaatgtcagtcaaatcctcttttttttcaagaagggaaacataagcattgataaaacgctgtaacgatatatatgttttcggtgttatacctaacttctccgagaagttacgttctaaccatttatagtttactcccagttccctgttcagcctttcaatagaaactgcacctctttgtttcccattgatatctgcttctttattcatctcttttatcagtcctgcactatcatcgaatacagcctgcaaattccagaacggtctgcctccaagctcctttgcatttaatcggcatatagaattctacctcactatccaaatcagacaaaaaggcgagcataggagtttcgtcattatatgccaaagattcagacatattactacaaggaaatctttcttcattaagaaaacaactgataaaaaataaattaacgaagattgccaaagaattgataatctagcacataatcacaaaatcagccagattgttatgcattaaacaatctggctgatttaattaacaaacaatagaaactataattcgcctatttcttcaaccgacaatccggtacattgggcaattgtttcaatattaattccctgctttttaaaattggcagcaataagacgttgttcttctgccttaccttcgactttgccttctgccttacctttttctattcctttctccataccgtcgtcaaaactagtatcgagtgcagcagaaaggtcacgttcgacggagaggctcagttcatattccagtcgttgatcgggagtcatacgctctacttccacgatacttttcagtttacggaatatctgattgttcagttcttcgggtaatcgttccatgatctcgatattatttaatacatataaccacttcttataaagcgtatcacactcatgcaaaggtaatacaaatttcggcatttcaagatagatttcattaagcgtttcgctgaaaggaatcttcagttcacgatccatacgcacaatatcccaacggtatttctccggacgcgacggttccatgatatagttcagtacgcaaatgacatatactttactgatatgatagttccatcgtttacgaatcctttcatccggttccttttccaacttctcttttacaatcatggattgttgctggatagcaaaggatgcataatacagtactctgtcggagaagtatttctgacggcttttttgcatttcgacaatgaaaacttctccgctttcattctcgcaaaaaatatcgaacacggcacgccgttggtcctgtttcaaaccaagcatctctacattacgaaaggtgatgtctacgattacttcctgttgaatgacttcattaaggaaactgatgataagatctttacttacttcactgccgaaaatctttttccagccgtaatccgagaaaggattgataaatttgttcatagctaatggttttatatatccgttaataaatatgggcaaatatagataattattttatagattggttataggtatgtaactatttttataagttttaatctgatccgcccttatttgctcatcgaaccatcctgttgttttctatactccgtcggggtacaattatatttctttgagaatgcccgataaaaggtagagcggttggtgaagccggattgaaagactatttcatcgatggtcagttttgtttttataagcaaatcggcagcttttagtaaccgacagttattgatcagttcggcaagagtgatctcttcaatctcttccagcttacggtaaaaggtacgaagacctatgttcattttctcagcgatcaattgggcagacagatctttgtttcttagatttttattaatgatcttcaatatatcattaataaatttcttatgctctttatgggatagctttccgttctctaacgtgtatgaactcaatggagacgagaaatattcacggagactttcttttctctccagcaggcgttgtacggaagatttcagaaaatccacattaaacggcttggttatataaagttctgctccggcattcagccctgcagtctgcccttcaatatcctgtcgagccgataacaggataaaagggatatgagcagttgtttcatcctcttttacctgccgcgaaaaggtcaggccatctgttcccagcataatcacgtcacaaatgataaggtcggggtgtatatcttttaatatttcagaggcctcaataggacctgcagctgtcaatacattataatcgtccctgaatatatcgaagataagccagcggatttctatttcatcatccacgacaagcaatgtcggtttcgatgtgtcgataggactttcagggatttgccaaacaggtgtacgttccggattataatcaggcaacgatacagccgtctcctcgctcgatccggcaagagaagcttcgaggtaaggcagcttgatcctgaaatgtgtccattcatccgggatactctctacttcaatcgttccgccaagcaaatgcaccatattgtaagagattgccagacctaacccgttacgcgaccagaacgaagtattgtcgctttgttcaatgttttgcaaaatgcggtatctgtcaaacagagtaggaatatcttttgctgctatcccctttccggtattggagacagtgatatacaaattattagaatcgattccgatcctgacaattactttcttctcgttttccgcatatttgaatgcattggataaaagattgagaaggatggtgacaataaaatccttgtcggagttccattgaataaaaagggatatctctttttcaaatcttacagcatgcgattccgccatatcggtgaatgaatctgccagtttattggctaaagcggttatatcgacaggtattattacgggtttcttataacccgactcgatccgattgaattcgatcagatcctgtatcagcgaattcagcctctcggcattctgcttaatgatggaagtgtatttccgggcgggttcactcaagttcttctgctccatcaaacggttgcaagggccgtagataagcgtaagcggcgtacagaactcatgggatatatttgtgaagaactggagcttggactcgtatatttcctctttatgcttctgttccatcttctgcagacgatccgcttttttctttctattgtaaacgatccatatccgggtgacaagccctgtcacaaccagtaatagtaaaaaataaatgcatcgggcccagaatgaaacataccacggaggtaaaacttcgatatttagtttatagatataactttcttttcccaatactttattgtagtactttatatacaatgtataattccccgggtgaaggtcagcgaaagtgattatatcggaacttccgttggaagtccattccttttcaccgctatccaacttataataataggaataaccattaccgttcagatagtcggtcgcagagaaagagagcgaaaagaaattctcgtcatgcgatagtttcagaatcgtcttttttcccttctgcgacataaattcctcaacagggtactgcctatcccgtatagtgatcgtcctaaaatagactggcggcatatagtgttgcccttcatcataataattgcgacggatagtaacaaagccattggttcctccgaagaaaagcgtcccgtcattttcgtttttgaaagaggaaccttcattaaattcaagtatcgaaagaccgtcatgatgatcgtaagtgcggaacaattcctggtctgtattatacaagatcagcccccggttggtacttaaccaataaccggcaatggtatcaggaagaatactataaatgctgttggttgggtatttgttgatctcattcaataatttataatcgtccggaccatactttaccaacccgaaattggttccgaccagatagtttccgtgataatctttctgtataacattggtttcattgatcgtatttcctttaaaacggatattttcccaggtagatgtagcgatattcagccggaagaagccttctcccttattcatgcaccataaaatagaatcgttttccggatagatatattgaaaacgattggtaaactcgtcatcttccctgactgtgaattgttttacaacagttactaaaggatagctgttccgccattcgagtgtcgcctgtatgatccccatgccaagcgtagatatccacagcagagagtcgcgttcatatatatcgaatatgaattctacatttctattcccatatagcacaggaataggaatgatacgtttttctatccgattaaaatagctgagtccgtgttcacttccgatccagaggttatcctgtcgactggatgaaaaagaaaggatcgtattatcccgtaacccactatttgaagtagagatcagttccatacggtgatcttccacctttttatccggttgaaaatcaaaaacacgaagaatgccgtctccccggctacccaaccataaagtattctctttgtctacgaacaaagcatttataggttggcgcaattttaacggaagatcattcaggaggacggaccggatggaatacaggtcttccgaacaggtaaacacaccgtgtcctgaagttcctacccaaatcatatcctgataattatccttacgcagacagttgattccgccggtaatctccaatgtatcgaaatgataaccatattcacctttcctaagcaaggatagccctttcgtcttaaaaccaatgaaatagtcgtcatggaatttcagaagggatgtgatgttgtcttttccggcaagataatcctttaaatgatatataggaaatgctttacaacaggatgtatcgaattcatacaacgtatatgtgttatccacgaaatacgaaaggttatcttcgttcgcacaatagacgataccggcggaatgcttataacctggcaaagggaaaaggttcgcattaccctgctcgtctatctgaatggaaaaacaaatgttgtcgccgttctttcggaaaatccacaatcgatcggaatcatcgataaagaaatcggctatatcgtttgctgccagatcgggtatgaacttttgctcaaactgttcctgatctttaagcgtataataaatgctattgttaccctgtaccaggaagatatttccccgactgtctttatcgaggaaagctatccggttaaacatatcgaacgactgggtgacagaggttttcaagtctatcttatatagtccgtgataagtctgaagccagaccttcccaccggtctgctctatcttctcaatccggctaccggcaaaatatttctcgccgtccccggggctgtactttataatacgttttccatcatagatatctaccccacggctcgtacctatccacataaaacctttttcgtcctgatagaatgaaaagatgttactgctggaaaggttttctgcgttatttattttccgcaggttgaaacccttcaccgacggagcgatcagtaaaagggccgataagaaaagaaaacaatagaaagttctcttcctaatagctatatcgaagaatgaaatcatagacaaatatagtcttatttcctgtctccgctatgtctgacagtgacaaatgtatctctctccatgacacgccgatcagatctcctattatctcttctccgtatagaaagcacttgattagttttgcgacatcaatcataaacatatcatcatgaaaggtactttaattcttattcttttagtgttcagcttccattccgttatggctgtttctccccggataaaagggatgatccgggacaaaagcacaggcaatccgatcgaatttgcggatgtcatagtattaaagaaaggggaaacggcagctgtttccagtacgctatccggaacagacgggtctttccggttagcggatatgaatgacggggaatattcattattggtcaggttgatcggatatgatgtctatacccgtgaaacgattacgcttcacccctcccagcccatgttggacctgggtattatcgaattgcaaccactggaagtcggattatccgaagtcgtagtggaaggtacgaaaaggcagatcatctataaactggataaaaagatcatcgatgcatccaacaacctgatgggaagcggcggtacggctgtcgatattcttgaaaacgccccttccatacgggtcgatgtcaatggtgacgtaacattcagagggagtagcggctttaaagtatatatcgatggaaagccgagcttctattctggtacacaggcattgcaacagataccggctggacagatagaaaatgtggaaatcatcactaccccatcggcacgttatgatacggatggtgaagtcggcatgatcaacatcgtcactaaaaagcataaacgccagggtattaacggtatggcgaatatgtatggcagtacagccctttccaatggagtcgatttccttatctcccagcaattgaataaattgcaatggcattttgccgggcattggaaccaaccgatccgggaaagccacttcgatcagcaaaaaacaactattgtcgatgatgtaacaacaacatccatctctcatggtcccagaaaagggaagaactaccattacggattgcgcggaggcatcgattattctttctctccgaaaacatccgtcaacgcagagttgcaggtcgtttacgacaaattcacccgtgacggcaacctggactacacggaaacccgcaaagacgctaccggtgaatccgtcccgcacaacttcaacagccgcgatgaattcgacctgcattcgacagtcaatatcgggaaagccggattttcccataagtttaatgacgatggacatgcactttccggcagtttcatgttaggatatgaaggaaatcctatggagtatttccagagcgacctgtttgataaaagtgaccaacgccaacagggacatcgtgcctgggaggatgaaatacgttggacggtacggggtaatgtcgactataaatatccttacagtaagaccggtcatttggagagcggctatcagtatcattcttacctggaagacggcgattacagtatgcagttctggaacccggagaaaaaggagttctactggcgcgaagatatttacaacacattctattttcaacgtggtatccattcggtttatttgataggcagcgatagttataaggcattcgatgcacaggtcggcgtccggggcgaacatacgcaccaggtattacgcagctccatcgaaggagcaaatcgaaaagtgaaccgtttcgaagtttttccttccgtacatatcggatatacacttccccacgaacagaaactgacatttgcctattcgtaccgaaccaaccgtccggaactcttttacatggagccatatatcacgtatcgcgattactacacagccgagatcggaaatccagacatccgtcctgaatatatacattcctttgaactgaattacaaaaagaacttcggagaacaattattacaatccagcctgttttacaggtcgcgaaaagataagatcgaacgcttacgtgtcccgtatcaagccggagtgaccctcgactctatggcaaatgtcggaaacgaccatgctctgggtatcgaattaaacggacagctaacgattaacaaatggtggaacctgaatgtaaacggaaacgtttactactataaagtagtgaacgatattcaatcgggtggaaagaaagagaccagtacgaattatgatattacattaaataatatgttccgtgtatttaagaacactcgcatccagttggacggtaacttcgtaggtccgtcggttacgacgcagggacggtcggacgctttctggttcgtcaatctagcaatccgtcagcaactcttcagtcccaacctgcaatcgacactttctttccgggatatattcaactcagcccgttacagaagcgatattacaacagcagacctgcaatccattacacgcatacgaccggattatccggttataactttgtctatcagttatacattcaataatttcaaaagaggttcacaaaactcacgggataaccgggatctgtttgaaggaaccaatcattaaaagagctcttaagggtgtgccaaatgttcgtataaaggaccacaagatggtacacccttcatacaaatgaattttggaatatcaacattcttattgaaatttcaataactttgcaattcaaaatcaaagtaaatgggcaattctgaaatcattatatatctgttacctctcgtctttatgatacatgactttgaagagataataggcttcaaagcatggtttacaaaaaatggtacatggttacaatctaaatatccccgatttagagaacaaatcagtcatttagaaacaatgtccgtaccttctttcgcattagcagtcgcagaagaattcatactgattagtatagccacaataatttatttactttttgaatggccttatgcatggctagccttttttaccgcatttgcttttcatataggcatacatatcattcaatttataattatcagaaaatatattcctgtcataataacctctattttatctattccctatattattatcgggatcgattacatcgttcattcattttccttcaaagaaattgcaatctgtttctccataggattattggttgctattactaatttaatattggttcacaagataacacctaaactagataaacttatataatcatgtacttttacataataacttatcaataaaaacaatggatagatctaaaatcgagaaaataatcttttatagtaatattcttagaaaagaaatgcaagtttgtgtatacttacccaaaaactatgaaacttcccctccccttcctgtattatattttctacacggaagaagtggcaatgagaatataatgtttgaagttgatatacaacctaaagcagatttacttatacataacagaaatattgagccactaattattgtttgtccaagaattgaaaatagtcgtggtataaactcttcttttaacagccaagatattcctgattccatttacaatgaaagaattatcaaccttggaatgtatgaagattactttatacatgaaataattcctttcatagacaataccttcaacacaatacgagatagaaaaagtagattcgttggcggtgcatcggctggaggatatgcagctcttcataatgcattccggcatcaggatcttttttcaaaagtgggaggtcatatgccctcattagaattaactctagaaaaagaagatatgccttattttcaggatatggatacttgggaaaaatatgatcctatatctattgcccgtaacaacaaaataatcctcgaccttgaggtttacctagatgcaggagataaagatgaaggtgaattctataaaggttgctcaattttacaggatatattaaaaaagagagctattaattctcaaaaccacgtattcccgggccatcatagtattgaatatataaaatccaatatagaaaaatatttggaattttatggtaaacgtacaaaggaatagtagaatagtataaaaccgtaaaaagggtaatctttcccctgatttgggtatagaacaggatgtatattccttgtaattttgcattatgaaaatatacatctaaaaattaagcttatgatactcaacgattttttacaggttgtccggacacggggaccactcaatacaccggaaatccatcgtttcatggatgagatgagcaatgaggcacggcgtatcaccttcgaactgaacggttcctatcataaccccgacgagattcgggcattactttcgcgattgttcggacatgaagtcgatccgacactgcgtgtatttcctccgttctacactgatttcgggaaaaatatccaagttggtaaaaacgtttttatcaacgcctgctgtcactttcaggatcacggaggtgttaccatcggtgatgattgtcaaatcggacacaacgttgtgttcgctaccctcaaccacggccttacaccggaagaccggaagacaacctatcctgctcccattgtacttggcaaaaatgtctggatcggttcgaatgccactattttacaaggcgtaaccatcggtgacaatgctattgtagcagcaggagcagtcgtaacaaaagacgtggctgcaaacacgatagttggcggcgttccggccaagttcattcggaacatagaaatataaaacggagcatcacatcttcaaaaatatctcaacaaaaattttctaaaataaatcattcattctttcatcctgataaacatccttcatctatataaactacataatcaaacagttaacacaacaacatgaaggaatgaaggatttattttgaaaacttttttattgtatcactaaaccgaaatagccaccttcacaaccccatccaaacgattttcaaagacacgataagcctcttcaatctcgttcaacggaaatttgtgagtaataagcggagtggtgtctatcttaccttgttcgatcaattcgagaatctcggcacaatcacaaccgtccacgcccccagttttaaaggtcaggttctttccatacatatccggtaaaggaagaagctggggtttatcatagagggcaacaacggtgacaatcgcattgggtcgggcacaatcccacgccaaacggaaagtattttcgctacccgctacctccaggactacatctgcaccgccgtgatcgctgttacgaagtacgaaatccttacagttttcgggttccgtcaccagcacatccgggtaatgttcacggacaaaccggattctttcaagggacttttcacagacaatgatacgtcgtggcatcttcagcatgacacaaagcaatgtacagataccggtaggaccggcaccaatgataagtactgtatcatcattggaaatctccgaaatgcgggctgcccaaaaacctgtagccaacacatcaccaacaaatagagcttgctcgtcgctaaccgtctccggaatacggtttaatccactgtcggcataaggaaccctgacatattctgcctgaccaccgtctatacgacatcctaaagcccaaccgccattgggatctgtgcagttgttgacatacccatgtttgcagaagaagcattccccacagaatgtctctacatttacggttaccctgtcccccggtttgacggaaataacatcaggacctacctgctccacaataccgaccatctcatgccctactgttattccgggtacggcacgtggtacactaccatgtttaatatgcaggtcacttgtacagatactacccagcgtcacacgcacgatagcatcacgtgaatcttttatttccggttccggcttctcgcacagttcgaatttaccatgttcaatatatgtatatgcaagcataatctctttctgttaattaattgattttacaaagatagagaaatcaaaaacaggcataacaatccatacaactattttatttttaacccggggatcaacggagtagtgtcgatcagttccagatgttttaccatatcgagcgttccctgtttgtatttttggaaatgaggagtattgatgtggcttttataggcagtttcatccgcatagatttcaagtatagtcaccttattcggatgatctttttcagccattgcataaagtagcagtacacccggttccaaccgcatggaagcttctatctcttccttcagatagacattatattcagccaaccgttccggatcgactgtaattttcgacagacgtaccatattcttagcttcttgtgcgatcaccggatcatcgtccgatcccccgcaggcagccatcgacataacggccaacagcatcaatggaattaataaaaactttttcatattactactatttatcagattatctttgctttaattagtctgatacaaaaatagagtgccagaaacaccgggattgtatatattttacagataattataccttaatcacggattctgaaacaacggtggaaatcgtataaagaaaaaaactacatttgccatatattaaaacagaaagtgatatggaagagatcaataaagatgaaattatcgaactagacagtgtagatcgttacaacaagatcttcggacttgaaacccagcatcctttggtgagtgtcgttgacctgacccaatccacgcaatggccagaaagagcctggttccgctacggggtgtatgcactattcctgaaagatgtcaaatgcggtaacatcaaatatggtcgtcaatattatgactaccaggatgggactatcgtctgcttcgctccgggacaagtcactgacctggaaatgctcccgaacattcagcctcatgcacacggtattctctttcatcccgacctgatacgtggtaccgccctcggtcaggaaatcagaaactactctttcttttcttacgaaaccaatgaggcactccatctttccgaagaagagcggcaaactgtcatggactgcttacagaatatttcaaacgaactgaaacatgccatcgataaacacagtcgccgcctgatctgtgccaatatcggattattactcgactactgtatgcgttactatgaacgtcagtttcaaacacgtggtgaagtgaatagcgacatcatcgtccgcttcgaacagttactgaatgattacttcgagggagacgcaccgcaaaaagagggattgccatccgtgaaatatttcgccgacaaggtcttcctttcccccaactattttggcgatatgatacgtaaacaaacaggacgcaccgcctctgagtatatacaggaccgagtaataggagtggcaaaggaaaaattactctcatccgacaaaacgatgagcgaaatagcttacgacctcggctttcagtatccacaacatctcagccgcatgttcaaacgggtagttggaataactcccaatgaatatcggatacagaactgaaaagacatcaaacactgtatacagcttcttcctgaagacaataaacctagaaaacagataattcagcgaaagaagaaaatataaagagatatataaagctattttcgaatctgaagatatttccgtaagtttgtcctggaaaaaaaattaataaacatactttaattaatatggcagacgataagaaaattattttctcgatggttggcgtgagcaagactttcccgccccagaaacaagtattgaagaatatttatctgtctttcttctatggagccaagatcggtattatcggtttgaacggttccggtaagtctaccttgctgaaaatcatcgcaggcattgaaaaagaataccagggagaagtggtgttttcgcccggctattcggtaggttatctggaacaggacccgaaactggaagcaggcaagactgtgaaagaaatcgtacaggaaggcgtacaggatattgtagacacattaaaagaatacgaagaagtaaacgaaaaattcggtgatccggaagtgctggaagatcccgacaagatggatgcactgatcgcccgtcaggcagaattgcaggataagatcgacgcgaccgatgcctggaacctcgacagccgcctggaacgtgcgatggatgccctgcgctgcccgcccgaagatcagatagtcgatacgctgtcaggaggtgaacgccgccgtgttgccctttgccgcctgttgcttcagcagccggatgtgttgctgctcgatgaaccgaccaaccacctggatgccgagtcgatcgactggctggaacaacacctgcagcaatatgccggtacagtgatctgtatcacgcacgaccgttacttcctcgaccatgtggcaggctggattctggaactcgaccgtggcgaaggtattccctggaaaggcaattactcttcctggctggatcagaagacgaaaaagatggctatggaagaaaagcaggtcagcaaacgccgcaagacgctggagcgcgagctggaatggatcaacatggctcccaaagcccgtcaggccaagggtaaggctcgtctgaactcatacgaagcgttgctgaacgaggaccagaaagaacgcgaagccaagctggaaatctttatcccgaacggtccgcgcctgggtaataaggtgatcgaagcacagcatgtagcgaaggctttcggtgagaaactgttgttcgacgacctcaacttcatgcttcctccgaacggtatcgtcggtgtgatcggcccgaacggtgccggtaagacaacactgttcaagatgatcatgggtatggaaagcatcgacaaaggtacattcgaagtgggcgaaaccgtgaaagtaggttatgccgaccagacacataaagatatcgatccgaaaaagaccgttttccaggttgtttccggaggacaggaatttatccgcgtaggtggaaaagagatcaactcgcgtgcttacctgtcacggttcaattttgcaggtgccgaccaggaaaaactttgcggtgtcctgtcaggtggagaacgcaaccgcctgcatcttgccatcacgctgaaggccgaagccaacgtactgctgctggacgaaccgaccaacgatatcgacgtgaacacgctgcgtgcactggaagaaggtttggaaaacttcgccggatgtgccgttgtcgtttcccacgaccgttggttcctcgaccgtatctgtacgcatatcctgtcgttcgaaggcgattcgaatgtggtcttctacgaaggaacgtattccgaatatgaagaatacaagcgcaaacagggcggcgacacagagcctaagcgcgtacgttaccgtaaacttattgttgattaattactttataattcatttagaaccatgaaaaaaagaatgctctgcatggcggctatcgctgccgctttcctctgtttcggaagcgatgctaacgcacagaaaacaattaagttgttcaacgggaaagacctttccaactggaactttgtcgtcgacaaaaattccgttccggccgaacaggtttattccgtaggcgacggcgtgataaagatcaaaggacagcctttcggttacatgtacacgaaagagaaatacgacaactataagttgcatgtggaatggcgttggccgaatggcgaccagggtgcgaacagcggaattttcctgttgatcgccgagccgaagaatccgttcccgaacggtatcgaatgtaacctgatgttaggcagcgccggtgatttcgtcctgttgggcggttccgacctggcacagtatcaaggcaagcccggcgaacctcgtcccggtttcccggtagtgaaaaagaacgctcccagcagcgagaagcctgccggagagtggaacgaagccaacatctacgtgaaagacggtaagatcaacgtctacatcaacggcgtttaccagaacacgggatggaataagcagaaagacggttacatcggcttgcagagcgaagggaaagaagtggagttccgtaatgtgacgctcactccctggtaagattgtaataaacacagagtttgttaaatagaaacggaggcggtagcttggcagagtaaaatctacaaactaccgcctttcatattattctacttctatgcaacttcttgaagtaaaaacagtgccattttccataattccttcgatgatgacactgtaagtcgtagcattatctgaagtataaaaagagatttttgccctcaggtcttccccgaaagaaacagcaggttcccaatggagcgttgtacgtagatcaggttgtcgggtcgtatctgagggtaaatatttaggtgcataaaacgcttccggtttttggtaaccggataacacactattaaataatgatgcgttgtctttttttattttctccccatatttggtagtaataaccaaagcttttctgggtatcatatccagattcaccccgcgagtctgtccaaatgttgaatagtctgttcccacaataagcatcctggagccggaaatcacacctatagatttaatagaagaggctggtatcatattaatatcataaccgttaggcattacctggtcattaataataatcaaacaaggaggtggaatctctctagcaacccctttattatctgttattttttcagtttctccccgactccgtttttcaaaataatacttgtactgcatcatgcccggcaaataattcaacaaatcatatgtgttgaccggatttttccgattaatatcttcctctcccatctcatgtacaattaactgctcaaaaaatgattttttagccaaaaccgattcacgcttctttccaggaatatctacattcggtaactcgatcgttcttatattatgatctttcagatatttctccgtcgccttcgtttgataggctatcgcctttctttttttatcggcttcttcagaagaaaatcgatgaaactgtttaactacaggaaaagtatcttcatccattgtcaaaacaatattctctgaatttccttttttagtcatagcctggattacataaagggtactatcgggaaactctaatccgctaaagttaaaatgcccctctttatctgaaacaacaatgtccgaataatgattttctggcatataaagaatgacactagcctcaccagtcgcctcttttttaaaatatccatcttttacctggcctgtcaaatgctgagaagtttcatacggcaacacaggaatgatatattcttctttcatcagagaagagatatcataacgccgccaaccctgtgtaagcataagcacatcggcggcatttatcgcctggcgattctccggctgcagataataagatggatactcaatatatcctttcaactcggaagtcaataacaagtccgacaaaatggaagaggtcgtatcgggtaataagtctctgtcatcggtaactgccactgaaaaagagcccttctcttctactcctcttgcatcatccagacaaatatccaaaacaatcttttcccgcttttcatacacaggcttatctgcaaaaacagagacagttgcctgatctttattcaagcaaaagatcaagcgttcacttagtacatttcctgcaggatcgagcaatgtaatctgtgaaactccggacggaaagctttctgaattcagtatcaaataatcctgctccgctttccaacgtccccaatactgcatatatccacgtgtatggatcaggacgaacaaagtttctcatccagaatatatccgcttatgttacggtgtaaaccatcttttccaatagctttaaaagctattttatgaactatcccctgcggcaatcgtcctccttcgggaaaaaactgaatgtcgtaatcgaatgccgttccggagtatttcttctctagcttttgctttatatgtgacaggatataaggacggatcatcacacgattaacgatagagtcattatctgcaatcaactccgcataaacataacggctgtttgctacaggcagatgacttgccgcatcaaccagataagcacgaaaccatattttctcaccggacaaatacatagacttatccaaatgcagatgtagcttttcctggggatacaattcccgctgaatctggagtttacgctccacaccgtttgtcggtaattgagaaaaagcaggcaaacaagaaaaaaacagaatgattaaaagaaatgatctcttcataaacctctgatatttcgaacatctacaaatataggataaaaacacgacgtaacaaatcggtctcttctttgttgtatctaagtcaacaataaaaacgaacgccgacatgagactgtacagatcattatatcttcttctgctactattggttatgcatataacggggcaggcgcaattgcaaaaggtcatcaaggatattttttcggctgacgaaataacgacggaacatgccgactccgactctatcgcctcgtccgggttgcaaaaatacgatgcgactttcaagctgaaaagcggacagatacagaaactcgactcgctgcggcaagagacggtagccaaagagaaagagatgaaatatcacgacagctggtggcagacggggaaacatatcttttatttcgtattggtattgctgggacaattcctactgttccgcctatcttcctggctttacaagaaactgaaaaaccgcatccagcagttgaaagataccaagctgaaaccgatctccatacagaattatgagatactggatacgcagaaacaggtctccctgttgatcttccttgcgaatatcctccgctatctcctattgttcatcctgctggttttaacgataccgatccttttctccatcttcccacagacaaaagaactggcgtataagatcgcctattatatctggaatcccgtaaaggatatcctggaaggcatcctcggctatacccctaatcttttcacgatcatcgtgatctgcctggccataaaatacgtcattaagggcatccgcttccttgctacggagatagatgcgggcaggttgaagattaacggtttttattcggactgggcgatgccgacctatcatatcgtccgtttcctattgtatgcttttatgattgcgatgatttatccttacctgccgggagccaattcgggtgtctttcagggagtatccgtttttgtcgggctaatcgtctcgctcggttccagcacggtgatcgggaatattattgccggattcgtcattacttacatgcgtgccttcaaacagggcgaccggatcaaactgaacgatacggtaggcaacgtgatcgaaaagaccgctttcgtcacccgtctgcgcaccatcaagaatgagatcgtgacgataccgaactccttcatcatgtcatcacaaacagtcaactatacttcgtcggcacgcacttacgggctgatcatccactcggaggtaacgatcggctacgatgccccctggcgcaaggtgcatcaacttctgatagatgccgcccaagcaacacccggcgtgatgcccgaaccggctcccttcgttctcgaaacggccctgagcgacttctaccctgtctaccagatcaacgcttatatccgggaggcgaacaatatgacgaccatctattccgcccttcatcagaatatccaggattatttcgataaggcaggcatagagatcatgtccccccattacacggcgttccgcaatggcaatgcttctacgatccccaaggaagaagagacgaaaacgaattaagcaggcttcaaatccgggaacaggcgcacatgatcttatcctcgactgatcagaacggaacctcgctgctgctgccctggttcaggaaatctgcaccggcaggcggtatcggaggtaacggatcctcactgttcatattcgatgagaattcgcgcacggctacatcctcatctatattcataaacttcgcataatcgcctttaaaccgcagacgcacatcacctgtcgcaccgttacgatgcttggcgataatgatctccgccagaccgaccagcgagttaccacgctcatcttccgtgatcttataatattccggacggtggataaagcaaaccatatccgcatcctgctcgatcgctcccgattcacggaggtcggccaactgcggacgctttccttcggctccctgacggctttccacaccacggttcaactgcgacagtgcgatgatcggtatgttcaactccttcgccaaccctttcaatgaacgggagatcgtacttacctcctgctcacggctgccgaaactcataccactcgcattcatcaactgaaggtagtcgatgatgatacatcgtaccccatgctcacgcaccagacggcgtgccttggtacgcaactcaaacaccgaaagactcggcgtatcgtccacatagataggtgcatcatacaactccttgatcttgaagtccagctgctcccactcataactttccaaacgtccgctcttgatcttctcgcccgggatctcacatacgtttacgatcagacggtttaccaactggacgttactcatttcaagcgagaacaaggcaaccggcacattatgattcaccgccatattcttcgccatggaaagtacgaacgccgtcttacccatcgcaggacgggcagcgataatgatcaagtcggaattctgccatcccgaagtgatcttatccagcgcatcgaaaccggtacgcgtaccgctcagaccctccttctgattcgccgctttctgcaacaaatccatcgcatccttgataacgggattgatctgggttacgtccttctttacatttcgctgggatatctcgaacagtttaccttccgcttcctgcatcaggtcttccacgtcgatcgtttcgtcaaaagcctttccctggatcatcgcagtgaaagagatcaactctctcgccaggtatttctgtgcgatgatacgggcatgatattcgatatgcgcgctactggcgaccttgccggtcaactgcgagatataaaacggtccgcccacctggtccagttcgccgcgtttcctcagctgctccgtcaccgtcagcatgtcgaccggccgctggctggctgccagatccacaatagccgcatagatcatctcgtgcgacttttcgtaaaagcattccggcttcaagatctcactgatgatcgaataagcatctttttcaagcatcaaggcacctaaaacggcctcttccaactcacgagcctgtggctgcagacgtcccatatcagacactacaacaggtttttgtttcccccttccggagtttcctcttccggtatttttagttccttctgccattctctttagtaattttcgaatgccaaaaatacgatttttatttggtattcattccttttttctacctttgcagccgtaaaaagtaattaactaattatggacgacagtattccgcgagaaacattaacaaataaaaattagcggacggaggtttcttattacctctgttcgtatcaacaacgaaaggaggcaataatgagatcgtttctttattgtgaagccggctttgtggaaaaagacaagtggcttcccgactgctgggtaaatgtagaatgccctacccctgaagatatccaataccttttaaaccaatttcacgtaccccaatcattcctgagcgatatcgaggataccgacgaacgtccgcgtatcgagtatgaagggaactggttgctgacgatcctgcgtatcccggtacagagcaccgaaagcggcatacctttcacaactgtcccgatcggcatcatcacgaataacgagatcattatctccgtctgttatcataagacggaattattgcccgatttcattcgttacagtcggcgcaaagagctcgtcgtacgtcacaaatacgacctgatcctgcgactgatccattcgtctgccgtctggttcctgaaatatctgaaacagatcaacaacgaagtggcacgtgccgaaaaagcgttggagaaaagtatccgtaacgaagacctgctgcggttgatgaagctggagaaaagtatggtttatttcaatacgtccatccgtggaaatgaagtgatgctctcgaagctgcaaagtattttccaggaaccgatgtatatggatgccgaactggtggaagatgtggaaaccgagttgaagcaagcgcatctcacagtgaacatctacagcgatatccttaccggaacgatggatgccttcgcctccatcatctccaacaatgtgaacaccatcatgaaacgcatgacctccatatcgatcatcctgatggttccgacactgatagccagcttctacggcatgaatgtgatcaactatgtagaagaactaccgcacggatttgtcgtgatcgtactcttttccatcaccctgtcggcgctggcattctttatcttcaagaggatcaagtggttctgatattgttattgcaataaaaaaatagccacggaataaaccgtggctacctggcctgttttcatggaaacaatcactgtctcctgaacaacaatatatacttatttaagggttgcgcctccgtctcctccctgattccggacaatccagggtaacacattaaaatccattttcagataagcttcatattcatccggtttttccggatcgatctccggagttcccgtgccgagtccagagatattggtcaccagcaaacgataaatattgttgcgtacaatcgcaaactccatgactcccatctcattctccttattattatccagatgtctgatccagtaattataatagcaatagtagctcgacacctccggatctttccggtaacgtttcacaaacacttttgccagctcttcatcggtcgatccttccgtaataccatccagtttgaatccggcatctttcattgcctggatgccggtataaaatttatagttcgcataatagataacatcaggtctcgcatcagtcgtctccttattctctccccaaagagtctcaggtgtaaaactggccttaaaccggactccggtggaataagcattcaattggttcgttttaaacatacagttttcaagacagtaaaaaccatggaacgaattaaccggtacagactgccagttttctgcaaccgtcttcaatggataagcataatatccgtccgtattatcgaaatcggtagccccatctatcgttttcgagaagaaataaggatcgatcacatacccgttaacaggatttatctccccgaaatttccgtttgtaatggtataggaagaaggaacccggtttgccgtcaggactgccgtatgacggaaggtgtaaaaccaacggcttaagttgatgtactggaatccggacaggctgatggaaacatatttatcgccatcgccggtcgtcagatcgtatttctctttcgactgtccgaccaatactttagccatagcccgttccagatttatagttataatagtaggatcttccgacggtaaaatctcacggacagtcactttcaaattcgaatccgtagtaccctcatataaaccgctattgtcggcacgccctgtcatcaataaagtaccatcctcggtcaaaaccccgaagccgtctttataggtggatctgtccaccaggttgataaactcattctccgtattgaaagaacctgtcacatccccgttggcaaccgtaaaaacatcatacgtacccggatctatcaagaccctgttggccgtgtactttacgatatgttcactctggtttccggaagaagcattttccgaaacctgcggtcctgccgtacgggttatattctccaacgagatctttttatataaagccttcgtatccgaattgaacagataaacggtaagcgactttacattatactcattggcagtaccggtttcataaatacccgaagtttccgccccaccggctttggtcgaagaactgttaggaacgacaaaagcgaaccggacatttccttctccctcgtctacaaagccggaattatcttccggtaatacatctgcatcgttaatacatcccgacaagcccaataccaggcataacagtcctgctgattttacaaaaaagttgtttttcatatgataaaagcacttagtaaataattatacattcaatgacgtttattattctcaaaaaacgcggccaaattcataccggcctcttccgatccttccgcttttgccgctttcagcagacgaatgccttcatacagatttccggtcatcaactcatacacccctttgcaatttttataagccagggtttcatggggtgccatccgcagatactccccggctgcctgccagttcccctgctcgatagcagccgctgccgcattcagattggcaaccggatgagccgggtaaatctttacactcgtttccattatctgataaaatttccccggttcatttttatagctcaacgccaccatatacaattcgcgtaaagaaagcatctggggattcatttccgccaccaccctggcctcttccaggttaaaactcaattctttctgattccggacatcggtcgcatcactttccggagaaatatatgaagcttttaacccggatacttccgaaaccttcggcgaaggtgtaacatcattgattacagtattctttacttccggtgaccttcccgatcctttcagaccgaccgtttcccggacaatttccccggaagaagccagcctgtttaccttcaaaaacagttccggcatacgcatccaattttcggaagcaacagaagtattatagatcacttcacaaggggattctcccgtcagctccctgacaagaaaatatttctccccttcaataccttttcgtttattcaatacacggttccgttcatatatgcgatgtctttttttaccgttcagcaagacaggcgcaagttctttctcctgcctgttctcttttatcaccggaataatggtaaacgattcgtctgatgtgaaatcatgggtattgacaatacatttcaccgataccatcaacgaatcacctttcacaaaacatgactgcgattttatctccacatcaatatcctttgcatataaggagttgcaaataaaaaataagcccaacaacacgagcggattgattttcatatttattgtttttttattgtataaagtaaattagagatatgcctatttgtgttggtcccacataattggtatgcgccttttctatgcggggcgttcctttttcctgcccgtatttatcataactcagataagcataccccaaagcaataccaacttccaggttccatagcggacttatcatccattggtatccgtaagaaattccggcaccgaccagatttccctgaaaacgataatcagacaatattcctccccaattaaaacgcgcataatgggcctgtatacctacaaaacttccctgaaaaacttcaccaaaccatcttctgaattccggttgtataagcagatgtttcatcttcttgttatcagcaaaagtccacgggttataactgatgatagaactgaacgaataggcatctttgcattttatttctcccccgatattcaaagacgacgtcaaatcataaagtacatttgttttcactgcaatattctgacagttcaatttagataaagaactgataatcattattataaaaatcagatttttaggactataaagccctacaaatatcttacgacacattatcataataatactaaaaacaactatataattacttttatatcgcatatcagatgttatagaaaaatattaatactatatcagattatattactcacattttaataaaaaaataatgactaaaataaacgaacgttttttctagtcattattccgaaacgaaaattcaagataatatgattattgtaacttctcgaaaaatagcatatatctttctgtaattcaatgaaataaaaagataaaaaacgctttgtttttcatttaatataaaatatatttgcaccaaataaatgactagaaaaaacgttcgtttattttagtcattacatcggatctttatgaattcagcataaaaaaactctgtattttccgactttaattgaaataatatcggaaaatacagagttaaatagtcaaccggatgaaagcttaaagcagctactcttcctctttattcagttttctgaccaggtcatccgctgcacgaaatttcacggtacttctgggggcaagcatcaggggttccattgtttgtggattcctgacaggacgcggtttctgaagtataggagaaaaaactccaaggccacctatccttactttgttttcggatctaacttcttcaaataccgtgtcaatgaaggtattcaaaacattccgtacagcactttgcgtataccctgtcttttctgcgatagagtatatcaactctcttttgttcatcatatctttacagttttaaaatttttgttccgccaacgatccactgttccaaagcaaatcgttattatcaaatagtttgtagatttgtcgtatctggcttcctgacaaatagagctttttcaggcctttttcataatcggccagccgatgatagtccgaacccacataatcgtaatatcccttatccaacagattccgggcaaccgatcggggttgttttccatacaacccggccaacgagaacaaattcaactggaatttataccccttgtctttcagaaaagaataatcatcctgcgtcatatactgatacagttccggatgagcgataacaggcttatacccttccagcataagatcgaataaaaaggtcaggtatttctcgggtgccgataaacgggaagtctccaccaatatctgcttaccggggaaagtcaatacttttcccctcttgcgggcatcaaaaccattatccagcatatattcagcagccagatataattcaatatccgcaggacaacactctttcagaatggaatattttgccagtaaaagttctaatgaattattcgtacactcttccgcaatatggggagtaaggaagatccgtttcacaccgacctccctcattctctccaatgcggttatcgagtccattaaggactccgatcccccgtccacattgggaagcagatgcgcatgcacatctgtcattccctcgagcaatgtggtataaagaatgtttctctttggtacaatccaggttaacataacaaattcaatatttatttcttcttttcattcccgtatccatacccatagccataaccgtatccatatccgtatccatatccataacctgaatggttatagcgtacaccgttcaggatcagactcatattcttgaatttatcctgtttatacagtttttccaactcaggtagttgccggcgatccatcaatccggcacgcaggatataaatggtcaggtcagccacacgatttacaatcgccgcatcggccaccaagccggccggcacattatccagaataatgtaatcataccgcttcttcaactcttcgaccagggtttccaaacgagtgctcaacaatagttcggacggattaggaggtacaggcccggtatgaatgatatccaggttttccgctagttctccttttccaatgatagaatcgatattatccactttcccggataaataattagttatccccatgttagtaacgttactaacatggctgctaagggtacccttacgaatatcgagatcgaccagtatcaccttcttactggttaaggcgaagctcatggccaggttcatcgacacaaatgtcttaccggcattcgggttgaaagaagtgaacatcaccactttcatatccttcgctttcacacgcatgaaatccatattcgtacgtacaatacggaatgcttccgaaatactgtcacgcccgttttcacgcacgactatttcatctttattcttcttgtcacgtaaaggtatctctcccaggaacgggatcgatacggcatcttctatatccttgcgtgtacgtacagtcgtgttcataaccacctgcaaccaaataatccccgacgggatagccagtccaagcaccacagccgccaatagaatcatcatcgattttggtgctaccgggtttctgctcccctgagccgcatcgatgacacgggcattactttcggtaattgcctgcgacaaagcattctcttccctcttattcaataggtagagatacaactcttccttaattttctgctgacgctcaaccgacaacacatatttctgttgcgtcggtacggccgaaatacggcggctggtctgtgcctcccgctccttgatattctttattttgatattcagtccgacaatcaggttatcgatagcccggataatagtctgcttcatcgcaaccaacgaattgttcaggtccatcaccaccggattcttgttactgctgttgctgatcagtttgtcacgtttcaataatagaccgttatattcgctgatctgaccttcgatattcacatccgcaataccggaattagccggtatcaggtccgagcttttatgcgggtctatcaggtaatcgcggatatatttagccaaagtcacctgattctccaagccaagtccttcctggctatattggctgctctcctgcagatacatccctgtttcggaactgatgtcggtcaactggttttcccgcttataagtctcgatatcggcgtccacacttcctaattctttttcaataatgatcagacggtcattgataaaattggaagtattcaccgtcacctggttcttgtcgtttatcgcatcttcattatagacagcgatcaacatattcaatacatcctctgcccgtggaatagaaacatcctgcaaggtcaggttgatgatcgttgccgttttactggctaatgcaacctgaagggcattactataacccaaagcgacatccaccctgttctttttcacaacagccaccggcttaccgaaatatttatccgaataatataaagtcggagtaaccaccagctttccgatagatgtaatcaccgtatcgttcaacgccaccttcaacatttttgtctcgtccgttgaaaaatccgacaacatcacttccgtctccgtcaaaggtgtcacattcaacgaaaaagcctgtgtcgcctccgcttccggaaactgcacggcaatgggcgactgggtatacagttcaaccgtacgcaacccgtccttcaccgtataaccgatatccaggttcagccgttcggccacgctattcatcaaccgcctcgacttgaacaccaacacttcgttatccacattgcttttgacattgaacatgttcaactcttcaaaagcagccgactcactcagaccgcctcctttgctgttgtcttttatcagaaccgaagccgtacgcgtatacactttcggcgcccatttcagatacaggaagcccgctccgcaacaaatcagaacggataaaaggaaccaataccagttaatcagaacaatatggaaaagatctttcaaattcagttcgttttcttcccctctcaaataagtagtttcttgttcagaattcattaggttctccgattatttaaatattaataccgctattgtcgtcagcaatgaaatgacagacacccagacaccgatggagttattctggttaatgctgctctgacctgccttcgccttgttcggttccacatacacaatatcgttttgctgcaaataatagcaaggagagttaaatatatctgccgaccgcaggtcatggaaaaggatcgtacgctttccgttgttttcacggatcacccctaccctgtcacgacgtccatatatggtcaggtcacccgccatactcaacgcctccaacaaggtgatacggtcgccggaaatagtaaagctacccggacggcctacttcgcccatcacggatattttaaagttcaggaactgcaccgtcacgatcgggtccttgatcaggtcgccttcaatcagtttgttcttgatcagctccgtcaattgcatacgcgtcaacccttccgcatggatctgccccagaatcgggaaatctatatcgccgttcgtatccaccagatagcctaacacacgttgctgaccgccactagtagagcccaactgataagttatcatcggcatattgaatggcaaggccagttccgggtcgcggctgttcaccataatagccagcaggtcatcactgtggataatcacttcatatttctgctcgatctcctgctgttttaaaggaacgacatcctgcagataaataattttcttagtagacgtgcaggcggataaaaacaccgccatgcagactaccagataagttacatatttcaccttcatactcttctgtttcggattatttattcaccagagccaccggaatgtgttccatgacttgctcccttttcagttgttataaccaggtctaccccatcgtatttaacaaccggaatagtcaaagccacagtctgccctccgaatacgaccggaaaaccaaatacggttgtcgttgtccgttcgacgatagaaacagtcgttttcatgtcgccgcttattctgacatcacgcttcaatgtcatttcgccgacactcggagctccccctaccaacgatgccagagtcagttcgacagcaccggataaagcagtaatatcgctatcgctcaaaccagccaactgcttctttaacaaatcgcttgtcgttccgtctattttccatccaaaatgcgatgttacatcgatcgtctgttcctgcgaatccattttccccaggttgtcaatcacaatcgatttcagattttcagtcttggaagttcctttctgtgacgagcagggcacaccgaacgagtgatttgaaaatccgtcgatggaagtcacataatatccgttgccgtcataatctgctgctcctgtctcactccacacgccattcttttccacataatgttttacatcggcaaaatagacacccttgcctgccgggtttttcatccgcaattcaaccggtttctcaaatatctgcccgtcgggttcacagtttacagtagaaagactggcacgtaccgtacctgcctgggtctttttagccccctctttataagcagtcaccgttacatctgttgccgatttgaccgcacctgccggaaaagtcaactcgatcatcttctgctttatttctatcactgtctgttctgcatcgggggaaatcgtcaccggctgattttttgtctccagttcctgtgacagcaatacgatactttgttttttagcatccgccgggaaaccgacttccgccgtcactgtcacgtagccactcttttcgaaagtaacgacacagtcgtctttcgatttcatttccaactggaatgtaccatccgcagccgttgtcgcttcagcattcgaagcactgacttttaccccctcgagagcattgctctccgacgtcactgtcccggcaatataatagacctccgcatccagcggattttccacaatgacaggagtcggttcatctttcttacaggaactaaatcctacaccaattgtcacagcaagagacatagccatgctgacaaccaaatacttgttcgttctcattttgtcttcttttttgtttataattattatgatactattttgaccgttcagccaaatcgaccaggttatcttttataaaatcaggattgtaatacccccggctcctgttttcatccggacgtgttttgtaagagcgtcccagcttccgtgaagtataccaggggccggactgtgcttcatactgccagtcgaaatattccggcaatcgtacccgcacagccttatgtttactgcgttttttacgtggcaggggaatagcaaaatggaaaccgccgttcgcctccccacctgaatacatggcaaacaaaccaaccgtcacctccccgaaatggcggctacaatccccacgcaccccataatcgccatagatatagcggtgggccgataagtcgaattgcagattataatagggttcgttataacggatcaaagcagccccgctgacctttttccattgtgtcacctcccatttgccgccgtagaatgtagacgaaccggtcagtcctccggtcaacccgaaagcccagcgatccgaattggttcgatacaaaatatccaggtccacaccgatccggttctggttaaaattgcccacactcaaggtggcaaatacatttttcggtaaacggatctcctggcgcatcaccagcatccctgcacgaatataatccatctcccccacctggttattccacaccgggaatatcacctgcccggtaaaagaggctcctttccaaagtcctatttccactgccggagcgatattcaacaccgttccgtatatcttatccatccaggagttttgcagcttgacctgcgggtacaataccagatcgatctttccggccgagcggttcaccgctttcgcccctttcaaaatcttcatcacctcatccgtatcgtaactgatcgtcagccccttcatcacagctgccggcgatacctctttctgccggtaagcgaccaaggcttcccgacttaacgatacggtaatctgaggtatccgctcttccaatacgaccaaccgtatatctccttcgacctccggatcattcagcaatgtccggatcacatcaaacaacccgcgataagtaccccggtacacattgtcttcataagcgatacaaagcccgtcagcctgtgccacaacctttacattctccataccgagactgacaagtctatcctccaccgtcgcactccctttccaacagaacaggttgcccagaagaagtaaacaaagtatatgatatattttcaccatttaaattcgtaccttatccccgcagagacagccttgaaatcgtaacaaaaagcatgtaaggagaaataattgaaaagctgtgcggcagcccctatactaaccgcttccgcattatattcggccatcagtgtaacaggcctcaaaaaagccggactataaccgactccaccgaaaatacctttccggtaactatctttacgaaacgggatattccctcccagggaaaagcccaggtcatggccgcccaataacagatgctttgtcccgacaacatatacagacgagaaaaagcggttgcctgcggcactcttaaacatattcaattcgccggtggtaaacgcgtcattcgatcccaccacgatggccggccaccatttcccctctttcaagggacgaagacgcaatgatacggaacgatcctgattccatttacttcccttctcgaactccccatgaagcaatgtgcaacgataggccacttccacgaacggcaggaaagttatattcacaaaataatttccggtattataatcccagttggaaggcatcattgcttcaggcagaaaatcagcccctcccataaaggttccgtctgcctgcatgtccgctgtcgggattgtcaacaaccccgtcactcccaatgaatattgagcgtgaaggccggctgccatcaacagcaaacaggcagatagaatcagtttttttaaccggatcgatatattcatcatcgacatattcttttaaggttctcccagcacctccacaataaaccctacctggcgtggcgtaagaatacgttgcgtacggtcccaaccggcctttgtcaggcaacggatcagaccgccattcgccatcacccaggctttcaaccggcgggaagcagccgcgggagtcagtgtcggactatacaacacgcccagttccatccaggtaaaagtgcggttcttccactttctttcctcttcatccacaggctttatcttgtctttttcatcttcccgtttcatacccacctccagtccatagtggccggacgtttctgcctccgcgacagaccggtcaggtgagcgattccgatattcaggcgatgaagtgcttgcatcctttgtgtcgtatccgtaatgccggacaacctctgtatccctgtccggatacgctccaataacaaagcctcttccgaaggcgagtcctgtacaatttttttccggagataaccggtaaaccggtcttttccccaaagccggaacaacgagtcgggatcttctccctccggcaattctatcccgtaagcccgtataccctgcatcctaagaagggaaacggccttttccgaagcttttcttccggcagtatctgcatccagcatcaccagcacccgtgatgtatatttcttcaataacacgatatgaccgtcgcataaagccgtaccgcaaagcgccactgtattactgaatcccgctgcatgcatcgccagcacgtctttgtagccttccaccaatatggcgtattgcttttccctgattgccttgcgggcgatatgcaatccgtaaaggatctcattcttacgataaagttcactggtcggcgaattgatatatttaggagagccagggacctccgtcagtcgacgcgccccaaatcctaccagtatgccttcttcatcccgtatcgggaataccagacggttacgcatcgctttccattccccggaaaccatagccggtgaagttcctaccccaaaatcgagccaggtcggagtcaggtccgagtccccggaagcggcaggaaggagagacgaaaaaaactgaaggtttttttcaattgaaaattgagaattgaaaattgaaaatttttctgtttcacaaacggggtttgtcaatttgactccgggtttgacttcggatttaattttcaatgttccattttcaatttttaatttcttcaccgcttccccaaacgataccccttctatcttctgtaaaaaatggatcacatcccctttctccccgcatgcaaaacaggtaaaatattgcttctccggattgacggccaaagaaggatggtgatcttcatggaacggacaaagccctagcaggcttttgcccttccgtgtcagctgcacataccgtccgatgacctcttcgatctgtggagccgactgttttatatcgtttatttcctgatgtgtcatgatgttgcggtattacgatagttcgtgatttttgtatatgaaggattataacggaaccgtgcaatgccggtcgctccgttcctgttcttcacaatatagagtttgcccactcctacgaggctttcacccgtccgttcatctttcgtaatgccatgcttctcgggacggtaaacaaaagcgacacaatccgccacctgctcgatcgtacccgaatccctcaggtcgctcatcaccggaatatgcgccctgtcggcacgtgtgtcacaggcccggttcatctgcgaaacaagcagtaccggacaatcggcctccagggccagctgtttcagggcaactacattgcgccccacgacctgatcctgcgtttcattcttctgacggacagacgacaacaggtgcaaataatcgattaccaccagatcacactccccttgtttgcttttcagcatcactttggcacgtatatcgctgacggcgttacaaggcgtataatccatatagagaggaagatgttccagcttgcggctcgcttctttcaattgctccagctccctaccggtcagtccgctgatccgcaaatgatccggatccacatccgtcataccggccaggatacggttcagcatctgcaaatccgacatttcgaggctgaacaaacagacatgtttcccatccttcgccgcattgacggctatatgaagtgccaccgcagtcttcccgtcactcggacgaccacccagaataataatttcgcccctgtgtaaaccacccgttacatagtcaagttcctctatcccggtcaataaacggctcacatcctccgaaaccccggcacgcctggtatgccattgcaaagcttcttccgccaattctcctaccgtacgcatcacttttcccccggccgtgtcgcgccgaagttcctgcaacgactgttccgcttccgcaatcagcttgtcgggatcggcatcgaatttcgcggaactaaaattcaacgtcacgaacaactgtatcaggcagcgtaatttatattgccgtttcacctcttcggcataatgtattacattctccgcattgcgcacattcagcatagccggaagcagaaacgacagccctttcagctctttccagcgagcctcatcctgcccgtgcatttcggtttcaaccgtcatcatatccggctgcacgccctgatcgtacaagtccatgatcacaccgaaaacaaatcccagcgatttatccgaaaacatctccttgcttaacatcggagaaacctgcatcggagcatccaatgaagtcatcaggcaacaaaccagtgtactttccagttcggcaacagtcatacctgctgtatccgtattatctgtattcatccgacgttccccctttctttcccacgatccagttcctgcatgctccgtcctcctattgtgcgttctacagcggccatcttatatccgacttcttccgtcaaagccgcctgtccgctgtccttatccgattcactcccggagaaaagatcatagttgcaaattccgatacgggtacctccctttactgcattcaacacgatcagtttttccatttcaagtatcttcaggtaataaccgaccgaaccgagactgatagccgtgaaacgggccagttcccaataagtacccacatattctcccctgcggcaaacatgtttattttttcccagcgtcactattccatcccgaaagaaactcaacgtgatcagtgccatatacataagggccaaccgacgcttttttttctgtggatggatagacatgtttaataacttacgcggcattttgataaatgctttccccaggaaatccgtcacctggttacagtcttgatgatctttgttcataaccgtaaatattaatgtttgttagtatttacgttgttatacgctttctatttgcaaaagccattgaattatatatcctttcgtctccctcctattcaggttctattcgaccggcaacggttcctctttaatatagtaagaagtatttcttttagaaagaaatttataaataggcaattcttcaattttttcaaaaaataaaatcgcatatcaacgcttaaacaaagataaataccgggtttcgtaataaaaaaactattttaagcgtatatctcacaacccaacaagctatgtttcaaccgattaattatttaaaaatccatctctccctgcggcttcccgctttatttccattctgattccgtcatggatctgctgataatcctcattcgcggctttcaacagattacaaatgtaggattgttcgtagccggtattgaacaccagattaatcagtctggctaattcctcatacgaacactcctcaaacatctcatttcgaaacatacccgacatatactcgataaacaatttcgattctttcacccggatacgttccagattggacggtccgatatcatagccacaatgctccagtatcttctccctgtaatgattgaaaaacgatttagccagggcattccacgttttcttttttcttatctccggatcacccagtaataaagccagcaataaaatataatggctgttatttttcacatcttcaagatactcctccaaggaaggatacgacaaatatttccctgttatttcacgaaccacctttttaaaaatccgattattctttgtacaatttgcttgtttattttgttaatcatattcattctccgattaggcatccatatagcctgcaaggttgtgaaatgatatacctttttcactgaaaacatacatgtttcaactgcaaaacatatatgttttaacgtcgaaacacctatggtttaaaaccgattaattaactgtcgttatctactcctaactccccctaaccgcccctatctgtctgcgggttttcagtccgtcgtacctttgtaatgttatcgataaccaacaagtaatttcaagtatcaaccccaattgtcaattgttaattatcaattttcaattatcaatttttaaatctatgcctttaaagtacagacttgtcaaacgtaaagacatgagcaaagatgcagccgcaggagccgagctttattttgctcagaccagtatcaccaaaaaagtcgatctgaaccgtatctgcgctcgtatcagcaaatacagtacagccagtcgcggtgatatcctgctggtattagacggttttatcaccgtcatgaatgaatcccttgccgacggtgaatcggttcatctgggcgatttcggtagtttccgtatggtagccggtagcaaaggcgctacaaccgaagaagagtttaaaacctctttgttcaaccgtgctcatatcgtattctatcccggaacgatgttaatgaaccttgttcgcgatgccagttttgaaaaatgggtacttccgggtaccactcccccggaaggtgaagatgaccgtccggtaatcgaataatagtatgacaaagcaaaattacatccaacagtatctgcctctcgcccaacgggcgggagagcggttcggaatgaatccgatcattatcctggcgcagtcggccatcgaaaccggctggggcgaaagcgaactcgccagggagtataataacttttttggtatcaccgcctacggccgtccgaatcctttctgggatggtggccggacagacttgtctgccacaggagatcggccgtccctctggttccgcaggtatctcactgcggaagatagttttctcgacttcgcccgtctgatccactcggcctatcctgtggctgccacgctcaccttctctccttcggcctacgccaaagagattgcctacagcaaatacatcagcgaagtgaacggcgacaaccgtgctgcctatcagcgtatgctggtgtcgatctgtaagtcgatagaacggctaatcggcaattaactttcaattatcaattttcaattatcaattcccatgaatgtccttgaaacaattctcaacttcctcaccagccttgcccggatcatcttcccccgcaagcgaaagccggcagccggtgactgcccctgtcctcatcctctgcctgctcctcctgagcctcctctccctcctgatgcgggagacggaagtgaccctgacctgcatcggggcgatactctcgctctcgcccaaggagactggggaaacaaatcctcccaggccgactggctcggaatgtcaggatatagcctgatgctgatgggcggggccgggtgtttgtataaatggtttattgcgtaggcgatataagaagagggagtgcacttcatgccgatatgagggaggtactcccttcttattttcttacttcagcaaatcgttttcccccaacggagtatagggaccgtcttttacttcaaacaacacagaaccgctatccagcacctccaatgtatgccattgattagccggaatatgtaccccaaaacttcctaccaaaggatccaacagggtcgactctgtttcttcttttttatcattataaaacatcacccgaatcttcccacgcaacagcaaataagtctctgccgtatgcggatggcgatgaatcggtaaaatagtccccggctccaacgcattcagcagacgctgggctttagcatccaaagaatcatgaaaattacagttcatacgcaagcggggggattcctgagcctgcttcgtcacttcgtttaataaagttgaattaattagttgcatgacttttatttcaatatttcctccaaaccattttattaacgactccggtatagctctgaattagcttgactaccttcaccgatacattttcatccacataattaggaacaggaattcctaaagcaccgtctttattcatctcgacagctacatccacagcttgcaacacctgttcggtcgtaatgccagctaagatgaaatttcccttatccaatgcttccggacgctccgtactggtacggatacatacagccggaatcggattgccgacagacaggaagaaactgctttcctctggcagcgtacccgaatcggataccactgcaaaggcattcatctgaagatgattgtaatcatggaatcccaacggttcatgttgtatcacacacggatcgaaccggaaaccacgttgttcgatatatttctttgaacgagggtgacaagagtacaggatcggcatatcatacttttctgccatcgcatttaccgcattcatcaggttgaagaagtttacttccgtatcgatattctcttccctatgggcagacaataagatatactttcctttcttcaatcccagacgttccagtacatcactagctttgatctgttccaggttactatgtaatacttctgccatcggcgaaccgactacataagtacgttctctcggtgtaccggctgcattcagataccggcgcgcatgttccgaataacacatattgacatcggctgtcacatccacgatacggcggttggtttcttccggcagacattcgtcgaaacaacggttgccggcctccatatgaaaaataggaatatgcaaacgcttcgcaccgataacagacaggcaggagttcgtatctcccaatactaacacggcatcgggcctcacctccgccatcagtttatacgatttggcaatgatattccctattgtttctcccagatccgctcccactgcatccagataatagttaggagcacgaagtcccaaatcatcaaagaatacctggttcaatgtataatcgtaattctgtccggtatggaccaggatttgatcgaagtactgatcgcatcgtttgataacggctgccaaccggataatttccggacgggtgccgatgatggtcattaatttcagtttattcatttctcttcaaatggattatggaagagattgattttcttagaataacgaagatagaagttctcttaaacgttacaagtcctacctggtatctcttaccaaagctatatagagaaaatcctcttgtataaaatagtaaactttactttttttgttgacaactataaaacggtattggtggttttcatcagataaatccggatcgactttacccatatatggattaaatgtcaataggccgacttgctttctaatcatttgccatactttacgggcagaagcatcccccgttctctgtcttatataagagagtgtttcagcaaaacttttttcagcggggatgtccaaattacatccatcccatctccttccccaatcgttccatcacctcttcggtagaatgaaattcaccgcgcttatgagctttaaccgcataatcggccgaagcatccaacatttcctttaaaataagcgtttctgaatttccttttgaagccaattctttaacatacttataaacttcggataacttttcttgatccaaatttataagttccttaaaaatatcgactctcaacgtatctacactaaaggtattcatatcgttttatatttgtagttcctttttacaaaagtagtaaatcatttagaataatcattctctcttctttatttaacatttacacctcttcaaaataagtatccggccgagtcgggtcgaaaggttcgtttgcccacataaaagtgaccagttcttccgtatcggaaagattaatgatgttatgcgtataaccgggaatcatttctacaacttctatcttttctccactgacctcaaaatcgattacttcatccgttccgatcttacgaagccggatcaagccatggccactcaccaccacgaatttctcattcttggtatgatgccagtgttgacctttggttacacccggtttcgatatattgactgaaaactgtccccggtcaggcgtacggataatttctgtaaaactaccgcgatcatctgttttcatctgtaccggatagctgaatttctctttcggcagataagacagataggtcgaatacaacttcttcgtgaaaggattgcccaaatcaggtacactcaaattatccggcatttccttaaaagaataaagcagatcgacaatacctcccaatgtcatcgtatgaaccacaggaacgacacaaaagtctccctcgtgatgttcgccacccgataaagctgcaatcagttcgtctaccacatcatccacataaaccaggttcataaccacacccggatcattcacccggataggcagatcattggctatattgttacagaaagtggccactgcactgttataattgggtctgcaccattttccgaacacattcgggaaacgataaaccaatactttcgccccggtttctttcgcatactcgaacaacaggttctctcctgcccttttcgattcgccatacggattatccaaagccgcctgcgtagatgatgagatcatcaccgggcaagtattgttatactttttcaatgtatccagtaaagtagatgcaaagccgaagttacccttcataaattccgcctggtctttcggacggttcacacccgccaggttaaagacgaaatcggcattcttgcaatagacatccaactcagccggatcgctgtctatatcatattcgaagacctttagatcagttcccgaaacaggataattccgtgctttccctgattggatattatggagttgggaaacaaggttccgaccgacgaatcctttggcgccagtaactaatatgttcattacattaaaattgatttattcgcttctgatttctcttggttttgcccgttcgatcagtccaagatcttcctgaataaaacgtaagcggagtaatagttttttcatgccttccacatccagacgtgtggtattatggctatgataatcttctatcttagacagacattcgctgccttcggtaaagaacttatcataattgagatcgcgtgtatcgcaaggaatgcggtaatactctcccatatcgatcgctttcgccatctcttcacgtgttaccagtgtttcatacagtttctctccgtgacgtgtaccgattaccttcacttctgtatccagatacttcggatcgatctgtgcgtatgtctctttcaatgcctgtgccagaacggacagagttgctgccggagctttctgaacaaacaagtcaccgttatgaccatgtgtaaaggcatagatcaccaaatcgactgcatcatccagagtcatcataaagcgggtcatttccggatcggtaatagtgatcggtttaccttgttccatctgttccacccaaagagggatcaccgaaccacggctcgccattacattgccgtagcgggtacagcagatagtagtctgcgccccttcgcccaactcacgtcctttagcaatcgccaccttttccatcaaagccttggagatacccatcgcattgatcggataagcggccttatcagtcgaaaggacgactacattctttacgccatgttcaatagcggaaagcagcacattttccgtaccttctacattcgtacgcgtagcttccatcggaaagaattcgcaactgggaacctgttttaatgctgctgcactaaacacataatccacaccgcgcatcgccacatccacagatgttttattacgcacattcccaatatagaatttcactttaggattttgtaaagcatgacgcatatcgtcctgcttcttttcatcacggctaaagattcggatttctttgatatcggagttgataaagcgcctgaggacggcattaccaaaagaaccggtgccgccggtgattaggagggttttgtctttgaatactgacatatatattctattaaaattctaataaattcattacaaaatagacttcttgatttcctgaacgatataatccacatcttcatccgtcacacaaggaccacttggtaaacatagaccttgtttgaacaaagattcgctcacaccattcacatagcaaggattgttcttatatacgggctgcaagtgcatcggtttccataatggacgcgattcaataccggcagcatccaatgccatgcgcatcgcttccacattcttattcggctcacaatccgtatgcaaagaagaagcttcgtgtgtcacaccagcagcaccacctacggctccctgaacaaccacttcataagcatgttcttcacctttcacttgtaagtcaggatcaagtaaaatcgtattcagccaatagttgctatcgaaccgggaagatggattttcatgcagtacaattccctctactccggcaagtaactccttgtaaagacggcaagtgtactgatggtgagcaatatgttcttccaatactgtcatctgcccgcgtccgataccggcacagatattcgacatacgatagttataaccgatctcttcatgctggtaataaggatatgactcgcgagcctgggtagcatagaacatgattttcctttttgcctcttcatccggacaaattaatgcaccgcctccggaagtcgtaatcatcttattcccattgaaagaaagtaccccgtaccgtccgaacgtaccacaaacctgtccgtcataccggctacccaatccttcagcagcatcttcgataaccggaatatcatacttattagcaatcgccataatctcctcaatcttggcaggcataccatacagataaacaggaacgatcgctttcggcttcttacctgttttagatatgcgatctttaatagcctcttccaacaactccgggtccatattccaagtatctgcctccgaatcaacaaatactggagtagctcccagataagtcaccggatgcgaagaagcacagaaagtaaagctctgtacgatcacttcatcccccagtcccacaccacaagccaacagtgcaagatggacagctgccgtaccggcggaaagggcaacgacttgtttattttcccctataaatgtttccaaatctttttcaaaagcgtttacattaggacctaaaggaaccacccagttggtatcgaaggcttcttttataaaagtctgctctttgccgctcatgtgggcgaggcaaaggtaaattcgtttgttcattattatttatgattaaatctacaaagacaataattctttcagagtatgtatctttacattaggtaggtactcttccggacaggaaaagtcctgacggtggatatttcttccatcatccaacaggcagatcgttttccaccccagcttattaggtgtaataaaatctttccgaaggttatccccaacatagataaactccacatcggcatatttgtcctgaaaaaacatgaaattcctctccgatggtttttcagagccaaactcttcagatataaccaagttctcgttttcgataaattgttcaagtctcaatgcctggaacttatttcgttgggttatagagcgcccatccgtgatcatccccagtgtaaaatcctgcttcaaaacctccaatgccttcaaggtgtcaagctccaaccggatattaggacgatgagacctgtagacggacagtaaatccgctttcgtcaacgacaaatcgtaagtatcgatcaaacgagaaaaaacatccgttttctctttataggtttccaacataaaagcatagatccctttcaaggaaaacttcaattctatccatccggcaatttcccgataagcagagtataagaaattgatttccttatacaacgtatcatccagatcaaaaatgagaatcttatttttcatatacgatcacctcgctgtcataccggagcatcaaagtattgtccgcccaagtatccatataggccaacgtttcacccaacatatactctcttacgacatattccggaaagttggctcccgcataataggaaagtggatatcccccgccaaatcgtggattgatctcgatcccgaccacatcattgtccgacttcctatagaacaattggatacagatgcaaccgactacacccggcaaatagcccaaccgttccttcaagaaccgaaccaaatagtttttgcgggtaaaccctttgttgatctcaccggcacgaatctctattctttcgcggggcacgatagctttcaccctattatccttgccataatacatatcgaccgtaaattccttgtattcctgtttgtcgatatattccataaagatcaacttcggatgattcaatatttccgatgtcagttcctctttacacctcacgacatacagatctttgcttaaggaaccgtcatacggtttggcgaaaagtggaaaagtcggatgatatttatccactggagccgggatgcgaatatcacgactattcaagaatgtactggtattccgcttatcccggcaagcttgtatgaaaggcaattccgataccatcggttctatcccattcttctgaaacagttccttattctccgccaaaaccagcaactcggtatcgatagtcggcacgataatccgaattcctttttctttacatattgtcagcaacatctctatataaccggaatcggtcaccctcggtacagctatacacccgtctgaaataatcccggcaggagccatcgcaggattcatatctgtcgtgaacaccttcgcttctggataaaaacgcttcaatgtttcttgaaactgctttgtcagtgtgacccgctttccggcggaagtgattaagatattagtattccctcgaagatcttgatactccaaagcagcttttgctgccaagagtggtttaagaaggtaatttacccccccccccccgttaacactagttaacatttttatattcaatgtttttatcgttttacacctatttcctacagccaaaaccccatctggaatatctttggctacaaccgaacctgcaccgatcacagaccattttccgatcttgacacccggtagaaccgtcgtacctgcactgatccaacttccttcaccaacatgaacgtttccacaaagcgtactatgcggagagatatgcacataatctcctatcacacattcgtgatcaacagatgttccagtgttaacaatgcaatgtttccctatacaagcacaagactgaacaaccgctccctgcatgatgaccgatccttcctgtacggtagcatatggagagactaccgcaaacggatgtatcgccgttccaaactcaacattcagtttatgagcgatcatctgacgtattttattatcgcctatacttattatcagaggtgaaatatcttcttttccatgaaaaaccggataacccaaaagttcatttatctccggattatcatcgacaagaccttctatctctatatgatttgcctttaatatatctatgatcactttagcatgaccacttgcaccgtataaatacatatccattcaattattacccgtaaaaaactccatcgtagcctgtccctcttgcgaaataccttcccgaacaaacactttttttatcgttaaaaagatgatctttacatccaacagaaacgaacaatgatccacataccaaacatccaattcaaactttttcgtccaactaatcgcattacgtccgtttacctgtgcccatccggtaatacccggccgcacatcatggcgacgagcttgctctttactatacaatggtagatattgaaccaataagggacgaggtccgatcaacgccatatcccctttcaggacatttatcaactgaggcaactcatcgattgaagtggaacgaacaaaacgtcccacgttagtcaaccgatcagcatcagtaagtaaattaccgccagcatcccgttcatccgtcatagtcttgaacttgattactcgaaaaatctttccgttctttccgggacgctcttgaaagaagaacgcaccggtacccttgttggcgaaatacaaccaaagggtaacaagaaacagtatcggccagatgacagccaacacacagaacacgagtataaaatcaattacccttttgaaaaaaattttatacatagatgtccaaacatttattaaaagttatctttatttactcatcttattaagtatgtaataccctacgagtcctataaccagtgtacatatcaaactaacacatagcgtattttcacaatagaaaagcaagctatacaaagccataaatgacagtaagatataacaaatgaaaaagagaatcacacaaatcatttgtgtacttttccaatctatagtagccggataagtaggattatgccaaattttgctcttattctcaaatccaaaaggtttgtctttgaagacatttcgacgatgttcattcaaatatcgccccataagcacaaaatatgttcggttacgcatgattgctgctaaagtcaaaaagacaaaacaggttgacaatgcgagtattccaccaacaatatagttggaaataccatctttgtaaacatccaacaatgttttatcagcctctctttcgtagtttaatatagtccaacaagcacctattaccacaagaatctgtccgaaagaaaattttgtcaaatcccaattaacagaatcgtaatgcctcaacatatacatacattgctgaaaatcattaactaacaagtctttttgaaaggtttgttccaaagactgtttggtaattgatacatcatcctgttgtttaaattcaaacactgtacttaacttttctgcattacggttcaaagacgaaagaattaccttatcaatccattctcgtatcattgctcccatgttttaaaacgattaattttatttactgtttccacccaatccccttcaaatgtaatggctctatcatctatatagacatcagctatcggtttccctccaagagcattgcctggttgattagggttctgattaatactgtcaaaacaaacaccatgacgaatcaaaaatgactttatcgcttctttgtttcctcgtgttgtatagatgataatataccacccttgttcttttaattgccgcatggcatctacagctccaggcacaagcgaaccaaaatgattatccccttgccagtcttcataatgcaccaaagtaccatcaatatccacacatattgtcttcatttttttatttattgagcttttccatccattttatgatgtattccttgtggagtttgtggagaggcatttattttaactcccttatgaaaaacaaatggatgttccttcgttacaaatattctacttcgatagtttatttccaacagtttgttaattagtcgacgggatggatgtccctctttttcacctccaggaggacaagagattataaaactacatggattcagtctccttaacaattcaggatttacattcttcctgcttccatgatggggcaactgtactgttgtaaaatcatttgtactgttttttttattcaacttttcatattgattaaaagcttcttctaacgcctcttttcccgcatctccggtaaaaagaaacttttcatttccaacttcaagcaaaataatcaagctcgtttgatttacctccgaagtattttcttcatcaaaccattcaatttctccattattcgggtcataatcatcctcagtcatcgtagccttcacatacggtttattccattcattaatccatgtttcaggggttttatccgaagccaaaagatatttttggtaaaaagatttagaaggtcctaaaatagacaagactcctggaatcagttcgtcttcgctatatgcagaactcaatataatctttctgcatttggctatattttctatcttatcagccatagaaaacgaattttttatacgctcagccaaactgtttggagtaatccttttatccttgaaatgctctggctttaattttccatccttccaaggacgattcataacgattttttctactgtaatatctctatcttccaaaatcgctttcaatcccgacaaatgatccaaatcaggatgcgtattaatcatcatgtaaatgagaggtttttgatatttcctttttaaaaattcagctattactctacctgtctcttcgtaacctccatcgattaaaaatacatatggattatcatcctcgtcatataattctatcaagatagcatcaccaccttttgagccagtccccacggggaagaaccatacacaatatttattctgatttaaagacatatttcacgttggtttaatcatcaatactacaataaaattttattctcaaacgtcaattggttatctgcttcttccaaactaacaaatgacgcactatttaataatttttgcattttttcaaaagcacctttagttcctatgctggatttcacataacgcatcatccgatttttcacacttccattttcccgaaaataagtttcatattctatccttgtcatcatgccatcttgattatgaatcaaatctcctatatggaaataagcaataaaataattattatgagacattttatattttatgaactgcaaagggaaaaggcgaaaatatcctccacctgaaaaagcaaaatccttgcctaacatgtgtgtcaacgcaatgggaaattctttcaattgaacattattatattctattaaaactggattgttagcagggaaagctggaaaaccaccaaaatctctcacggccggatagatagaagaatctcgctctataccacattctgccaaaatttcaatagcccatttatttttttctccaatagaaaaagccggtgcacgatagcttacgacagattgtccacttacatcttgtagtgcatcaatagcttctttcgtatcttcttgcaattgttttggagtcatttgggttaaccataaatgttcgttggaatggcaaccaatctcatgtcctctctccgatatttttcttataacataatgaaaatcagcggcgattcttcctacacaaaaaaaagttgccttctgattattttcatcaagaatgtcaagtatcttgtttaaataagaatcaaacttcctatatttttccacccgacctccacaaaacttcttttcgatataccattcctctatatcaaacgatagtatattcataactcttcgcgcttttgtatttgttttattactttagctggacgccccatcgctatagtccatgccggaacatccttgatcactaatgaaccggcaccaacaatagccccttcacccactgttacaccaggcatcacaaaagactccataccaatcaagcacccctttttcaaaacaattggtttcagtacatatcctaaagctaaatattcatcacccacacagtaatctgaaaaatcacgttgatgacatagcagacgtgttccaccagcaatacttacaccgtcttcaatgataattaaatccgaatgaccagaatcaatctttactgtatctccaataaatacgtcctttcccacatgacatcctatttgccgcaatacccatgggcgtacttttcgaggcaataagggagataacatccaattattcatcacccaactcaaaagaaaagagtctctaaaagttttatgtacccgttttatcaattgccataatgtaacttgaccataatccttttcagaataatgcattccaagaatacgcaaaaaacgataagttaaacttaatttttcagaattcataactatgtttctattacattaataatatgtggccataccacagatgaatcaaaattttcgcatatccaactacgtgaatagcgtcccatagaagtccgaatctctccattttttagcattagttcaattttgtcagcaatagactctggcgtaatttcacaatacacaccggttttatcctcaattatcgaatctatacaacctgttgattttgacacgattgcaggtactcccatagccccacattcaattgtaaccataccaaacccctctctatatgaaggcaacaccattatgctaaacaatgcaaaatacttgtgaatctcagtatactcaacacgttccacatgtattacatcattacaagtatctatatatttacgcagtccaacgctaatactatcacgcgattcactactgccaataataaacaatttaagattattaccatcactatatttttgcttgagtaacttaaaagcatctacaagttcagccactcccttgtctcgcactaagcgtccacaaaaaccaatcacaaagtcaccgtcttttattcctagtttttttttcaaaacatcctgctccgagtctatcaatctatcaggattaaatctgttgacagtgtcaatgccaccacaagtaccggcaccaaggaaatattcttgtgcactggattctattcgatacttttgtctaatatttgcgaccgatttacttacacatactgtcttatgtgccatcattgcaacaatcttatccatcaaaatgacaaatattcgcttgcccccatttagggtctcaaaaagtacgccatgagcaaaaataattctatttggaacacgcatcagaaatgcagccattgttcccaaaagcctagctttagcttgatgagcaataactgtgtcaatattattttgtcttatatatttgcaaattgctacaaatgccttaatatcactccatggagacaacgtacgcaccagttgaacgggatgatatttgatttgattttgcgttgcatagtcttgtatcatgtcgtcagggctacatatcaaatgcatatcatatccattttgacgaagatacataaactgaccaccaatgaaatttctggcactacttgccagattaataatttcaagtatattatgagccttactcttattagtattcataatttatcacctaaaactttattaaaaaatatttttttaatcatatctgcattgtgattcttctcaccacaaattcgagcattggttgccatttccctttgcaaagtcggattctctatcagattttgcaacctcgtcaaaatttcatcttctgtattgcatataatggcagccttctgttcggtaaaatattccattgaagctatatcattgggacctatggccaaaatacaacgcccctgactcaaatagtctgttatttttgttgaaaatgacagcctcgctgtcttattgtgaatatcatatatatcttccacaaacactaaaatatcagactttatctgctcctctttcacctgatcctgtgggatcgtaccttttaaataacttgtaccatcgacagccaattgtttcacttgcacctcagtcagcagagtctgtgtgtatatatctaaataggccttacatcctttctcgttaatcttctttagagctcgcacaatggccatcacaaccctatcgcgacctatattcaatttacccgtatatattaatcgatatggttgtattggattgtaaacttctgacacttgcggtagtgacacaatgggttttgtgacaatagtagaattgactccaaattccttgtcacactcagccttcattttagggcatattgtaagaatttcatcacactgataaacaaggctttttacagaacgacgcgtaaagaaacgccctatcttatatgacaatttactactttgtttatatgtaaaattgtcatcccataatactccaattacacgtttgggattacaatatttgataatgaattcattcagattgttaaaataaatataactctctatagggaagacaagtacatcaggattaaagtcgtccaaaaattccataagttccttagtcttccagtttcccaacatccatgctatctcacgtacagcaagaaataacagattcctattgcgcgaaaaatatgcatagcgtttcttttccaattgcaattccgtacttatttcatttgaaaaaatagaaacttctgaaccagtcattgctccgcgtttgaatacgctttttacgaccttcccttccaatatttgaaagtaccttgagcacgcatccgagtctggtaattcagcacgcatatagatgttggcaaattcatgctctatattaccctcaagcaatgtgctaaaggaatcatagcctgtctttttactccaagcaggtatagatgtgataagtattcttgacatttagaattacatttaagagctttgttttactgtatacatactgcatgtatatattacaactggtacaaaaatagaaatcataaaccacccctcttcaccaaacaatcctttagtatataggaatacagtagcaatacatatacctaagtaataataacttcgcgataaatggttacagaacttttttttccaaactattatctgactaataaaaagcataatgaaagggataccagccaaaagccccataccacctaatctatccaaaataacagaatggccgcctacttgatccccaccccaaatcatattagacagaaatgaatccattgaaatagcatgcaaattttctcgaccagttacagcccctatttcatcctctcctcctcgatagagagccaaaaatgattccatttttggttgcactgcagtgccttcaaaccaaccacataagaactctaaaaaatgctctaccacattgaaagaatatattatgagtacgcaaaccattattattacaagacgaaagaaattgataccacttttctttccatatgaaagaaaaaaaataatacaaatcaacatcgctactaaagatgttgtaacattggtatttaaaacaagtataatattacaaattaataggacgagtgcaaccagtttatgcttcccttctgctgatatataacccataaatgctacaggcaaagacattgcaaaagcatgcatcaatgtatacccaggcaatcccaagacatggatatctaattcggtttgggttgccaataatctcatatcataatgcataacgatgggaagtacagaaacaaaagaaattagataaacagcgactgatatcaaagcgacatagttatatacttttagattattacgataccacaatatactaacaatactaaatgaaggcagtgtccatgctatctctattaatagtttcttcgatacagtagctttcccaataccaatagttatatctgccccaaagaggaaaaacaatgtcaatataccaaaataacaaagagcccaacccattaacttgtttttatacgcattagggtataatataacacacattagaaatacaaatatatcaaccgtctggctatctaatgggaaataatctgacagcaacgggaataaaataaacgctgcaaaaaatgtatatacagtaagaaatattttatcttttcttgttaaaatatccgtatttaggtattccatcaaatatttgaatattagaaagtatcaatatccatgaaagataaagcccaattctgaggattcaggcaaatctgtttcatttcgtctgtaagaaccttgacaccatgattagcaaattttttagactgcaaaaaaccaagctttttataaaatttatacaaaggatggtttaatgtcatatctgcaaggactaactcaggcttaatttccttattgaatgctttaaacaaagctttgaggtcgactcttgtgtatttatacaagaatacttcaccaataaaaacaactacagttccatgaggcttcttacctattttgtatataatacaaccaagtccatccttgctccacatcttgattccactttgcgatttcatacgccataagaatgtctccttatcatagcggatatgtatagtatcactcttcagcatttctgcctctcgaatatctaacaagtgctcatctattgatgttatatgagattcaatatcccaaataggagttcctgcaagtttacgaatatcaaaacgaagtttccacaatgttttcaacggatttagatattttttaaagcctgtcaaagacttaatgtaaacccatcccaatttttcgtaagctttacgagaagcctctacactaatgttataaattaactcaccacctgcctcattaaaatattcatttagaaaagctttattcaatctcaagaataaatgttttcctctacattcctttgatacacaagaatcagcatattgtacacagattaatttcctgttaccataataggcattcataaaaaatgacgtacgactacctacaatttttccatttttttccgccaaatagcttacgcctgtcgattctttcattacaaagctagcctttctttcccaagaagtgaagtgctcagacttcccctcacatgactttgcaggccatacttcacaatatagttttaccaaattttcaaaatcactaggttcaacttttcttataataatatcatctttttccatcatctcaaatttcaaattgtttcatttacaaatcgttcaacaaatctcgccactgcctacttatactttgtattgaaaagttttcagattttgaaacagctgctttttgcatggcttttaattttgatggatttgacatcaatgcatcaagacgctcgacatattgttcaacactgaatgcatctaccaagactccatttttatcatcatcaattatgtcaaaagccgcttcataagatgaaaaaagaataggactcaccccataacacattgattcacacaaacttaaaagccacccctcatatatacttgacatagtgagtatggaggctctcttataatatgacactacatttgtttggaaaccttcaaatgaaacagattcatgaagattatttttgtcgacatatagtttcatccattcaagtttttctccatcacctaaaatttcaagcttccaatctggatgcatttttgaaattctattccaaacctctactaacagatgaacacccttttgtggcaccaaacgtccagaaaagagacataacttttctttattatccaaatcaacaacaacattatccggcttctgacatgttactggattatttatatatgtaagtttggtaggattcgaaatacaggttatatatttgaatattggaataaaacgttttgacaacaaaacatatttgtctgtattcttatacattttcctatggcgtttcattgaatataaccatattccaaatcgttttacaagagctaacggtgtattaccataatgaaacttattacttaacaaataacagttaggtgtattatgttcaacaataatcaactttggacgcttgtttgccattcgtatagctgcaaaaacatcatcctctttcccataataggaatcttgataaataatacagtctatatgttcattattaataacctgtaacaaatcatcactcaggttgttcttttgttcaaagtattttacattttgatcaagattgtttaatagcatcttatcactcagcggatacacagaaaaaatagaaatactgtagtctatacacaactcgttagctagatactcagtaaccttttctatccctcccaatccagggtaacgagtacaaaaaaaaagtatttttttcatgctattatttaccagttaaaactacaatcctattgactaaagtattgaatatgttaaaataccctaacaccttatatataaatactctcataggctcctcattcacaatcgaattacgaccgaaaataatcttatcctctttcatatatgagtaattcatatctgatgtgtaaattctcatataattagaatactttaccaaataatcgttggaagcctcagaataatagccaaatggataacaaaagtcatgaggttcataaccaagttcttttttaaacttttgatcaacttcaataatttctaaattaggattaattgcatttatatctgccattgaaggatgtgtaaaagaatgtgctccaaaaccaacaataccactattatgcatttcgcgcacactatcccacgtcaaatagcttttatctacaccaatcttccccattgatagaaagatgttatacttaagtttcagagatttcataaagtcgaaaatctctgtataatttgaaatccatccatcatcaaaagtaatcacaatatgcttgtaacagaatttcaagttttcagtattttccaactcatcaaatgtgtatgtgacatatccgttatcgtgaagatatttcatctgcttcttaaatatatccacatttgtttgttgactactatatcccttgcccctaactatgtcatgatagtaaatgacgtttacaaacttactccgtttattaaatatactcccaatcaacgggacaatattaaaatatatcacctttttgacaaaattcatatcacaatttactgatagagtaaaatatattcgttaaaccgacttttttgatcaaacgctttagaagcctccaaaatatcttctttcacaaatcttttagtcgaacatatagattcaatttgtagctgcaaagtaactacatcattacactcaacaatagcaccgatcttttcgtttataatttccggactaccgccagtacgaaaagtgactaccggagttccacaagcaattgcctccatattgaccgtaggataagtatcctgtctggttgcattaacaaaaacatctgctgctgaataaatttgagcaagttcttgctggcttgtcgttttatggatagaaataatatttgaaggcaattgtttatcagtatcagcattagtaccaacaagaacaacttgataatcgcaaggtaatcgttccgcaagtttgataaaaacatccaatcctttgctatatccccaaccaaatgacacaccaagaacaatatgtttattacctacaccatatttaatcttgaaatcacttgatactggtttgaatacagaaaggtctataccattattaattacaatgactggataatccttaaacatagactgctttaccaaacctgccaaccattttgatggagtaataatggttaaatcaagtcctctccgtattgcgtacttcttacgtttatacaactccgtactcctgtcaaacaaccaactatatacttttcgctgtggacaattatgacactgaattttccatttgtcacaatcagcaatcacaaaatgtgaacaataaccagtaaaagcccaacaatcatgaaaagtccaatatactttgagttttttcttgcgtaaataattgaacaatatcccaatgttgcagttatggttgtgaatattgtgtaaatgcacaatgtctggagctaaagattccaattcaaatattaactgatgagttacccttgttgcattaaacccatatccaccaaaaagtttagctttaagagcctgccattttacatatctatcgcttgaatacttaatgccacaaaaatgattagaatgaccacttgtatacaagatatagttttctatacattgttttgtaagcaagtcactgactgcaacacatattctaccaatgcttcctgtatcacaagttgcatttatctgcactaccttcatctatttaatgtactttctaaaccatttaccaactctataaaacatcggaatttgacgtaatggatagtaaacgaacaaatcttttactgcccaaaaatatgatttattaaataaggcacgctgaacgaacatgctttcttcaaattttggatcaataactatattatcattgtatacaatttctcctaactcctctgttggtctattaccataaacagcagccataccatggtcataagaggggtcataattcgttgcttccgcatcaaatcctatattcgacaccatattcacctgtgggtaaatattataaagcccatacttaaatgacatatataacatctgtatatcataacttctactaattctgccatttctcttttcacttaaatgtcgttcaaatttcttggtgtaccaaatacgttcgaaccaactattgaaattagccttataacttggagtcttgaaacaatcataaaatgtatctatcccaaattcatacttttggtgggtacgcttccatgttgccatgccataagtagaagctggaattcttgaataataataagatgcactaccataatgctgtccaaaatttacacctccaatataaccaatattatcattgtctttatatcgttccaacaaatcctgacaataaaaaaagaatgatttaacaggaagagaatcatcttctaagaaaatcattctatcctcatattcgaagagccaactccaagcagagtatccacccattgcacacccccgattcttctcatggaataagtaatgagcgtcacaatcccaatctacattctttacgatttgcctaactttatcgcaagcctttcgttcatctggtctgtcttcacgaggtgcatctgctgctacatatagttttgttggacgaactgaacgtattatgtcaaaaattattttcgttttatcaggtctattaaaaaccaataaaagtacaggagttataagtttttgattcgcaatcatattttctaaattcatttacaattacttttttctatctttttttatttggaataaaaggcacaaaatatttgtaacaatgaatagcataaatgtaacaatatacccataagcagctccataataagacccaatcctcacaagataactaatcaccaatacagataataaactggcaattactttagttgtcaaaacgcttttagaatagccggcagcaacagttatatcgttcactaaataaaacccaacaacaaaaatttgtgcaacagataatatttgagaatatttagctgattcaatatatcttccagcggtcaatatgtcaattacgaatggagctagtataatataaaataatacaaccaatgtttcggcagcaagcaaaataacacaaactctgatgagttttgatttattaaactttgcaacggattcatacaaatcaggattgaatgtagaatacaatgccattgtaaaaatatttatgtatctcgcaaattgatctcctacacaataaataccatattcatttgtatcaccaacacgctctaataaaactctactataaccattagtaaaaaactctaagcatccagcaatagctaaaggccaacaaaaagacaatagctttcttaacaatgttaaatctattcgtttaaaaatatattttttcaatctaaaaaaagtaataagaaagaatacaaatgatgaaacaaatgttgcaaattcatacccccatgctccttgatgaagtaaaacaacgcatattaatattgttattactctaaatataccacttgatatacaatatttacaatactcccttgtttttctttctattcgatactcagcaagctgaaaactaaataaaccacttatccaaatagcacctatggagaataataataatggaaaaagtggtatatttgattctgtattaaacaaataatgataaaaacatatgccactcccaacaattattgacataaaaagcgaaaataaaatcaacgattgaaccaccaacgttcttaaccgcattcgctcttctaaatcaatcttatagtaatttgaaaggtaaaatctcgttataaagaattggattaatggagtctctatcgcagcaaaggatgataaataacctataatcccataatcaaatggagataaattttttgcaagaaatggattaatagcaaccaacaataccatcgggataagcgatgatagcaaatataatcctgtatctgttacaattttcttcagcattattttattaacacaattctattttaaccatcttatccatcactcccatatagttataatcttcactattttaattgaagcatcttccacatatacaaaaacggaaataccatgatcgccttctttgttcatctctatcgctgtttctacggattacaaaaaatggttcgcatcaatactacctctaaaatatcctttctctatttctacaacttccattaactatctatttcctattcctttccaaaccaccatattatgatcactataagatgtctccggcgaatagcattcacaccctttcaacgattccgaataaaaaacataatcaatcctccagagcttgtataactggcggaacgtatattggtaaccactcccacaatcacggaaaccgtcaaccagatctttgcgcactcgatgatatgtataagaagctggcgtatcattgaagtcaccgcaaaccagcaccggataaggtgagcatttgatctcagcatggatcatatcggcctgttcggctcgtttccgatagttacttttcatttttaacaccaaatctttgactgcttttgcacgaatttccaaactcttaccgggagtggtaatgataccgcgataagcattgacgcttgtcgtctcgaagtggttgttgactacacggatgtattaattgtttatccgtacatcagctatcaatgacatattccgagaattttcataataaagagcctttaccaaatggatggggtaacggctgtaaatcgttgttggcaaatggtcggtacgccgactgatatatttatacaaaacataatcaaaagcgtatcggatactgtcacggtggtaataaccatcaccgggtacttcctgaaaacagacaatatccggctgaagttcctttatgtaagctgcagcttcattcattatgtacatcttattccaactaaaatgactggtattgtaagtgactacagtcagaggcgttccttccgaatcaacaacttctagtttattccaatagagtggctgataaactgccaataaataatctatatgtagtagaatggcaaacagagaaataaggcttctccacttcttctttgtaaacaattgagttattcccatcaacagattgcccgccaatattggccaaacagctaatgtcaaaagagaaagccaaatacaaataccctcaacatagtaccctccgatcaaacaaagaaaggataagataacaaagaatatctgaaaaaagttatttaaacttttcaaaggtataaaaagacgaattcttaaagttggaattaattttcttccgttaagtcattaatcattttgtcaatgacagataatagttctggaacattttctttactaattcgaaaaatctcaagagcatccacatcaaaataatgatgaacaatgatatcacgtattcccatcacatttttccaaggaatttccggataattaataagaaactgtctattggttattttgtctaaattctttaaactttctccgatagctgtcaatttcatacaaatactatcgagaagagtaacaccactctcacttaacaaaaaatcatcaggtgaatgaatagcagaagaacgctttatgatttgtatcaaagagtcatgaagcaactgcaagatatggagtactactagtttattatacataaataccctcctttaaaattcggtcacgcaaaaaagagtccatttgctttcgcaaacgtacgatatctactttacaacctaatagttcttccaattcacatttaatgcctgacaaaacaaagaagccgcgtaactctccctccacatatatatctacatcactattttcagtctgttcattacgcgcaacagaaccaaatatacccatccgggtaataccgtaattgtcggcattcctctgcatatatcctcgcagtaaagcgatgtattctgttgttgatttcatatgttataaatttcttatttacaaagatagaaatttattccttatccaacacctcatactccgaattcttactcttgaactcaggtacaatccctttcatatacttaactgtacccattttatccactttgatcgccaaatcgattaacggactcatgaccttacaaatgtcttcgtagtcatattctctcacctgggcacgatatattttggcgttattcgtagggagggtattttctttcgttgccagaagttcttcatatagtttctcgccgggacgaagaccggtatactggatttctatatcttcatcggggataagacctgccagttcaatcatacggcgagccagatcggcgatctttacaggagaacccatatcaaagacaaatatctcatttcccttacccataaaggctgcttccagtaccaagcgacatgcctccgggatcgtcatgaaataacggataatgtcgggatgggtgactgttaaaggaccgcctttcgctaattgctcacggaaacggggaataacggagccgttactgcctaatacatttccaaaacgggtggtgataaaatgggttttacccggatgcaaacctttactgatagcaatgctcaggctttgtacatagatttctgccagacgcttggaagctcccatcacattcgtcggattgacagctttgtcggtagaaaccataatgaacttatcgacattatacctgactgccatatccgctacattacgcgtaccgtatacattcgtatgaacggcttcacagggattctcctccatcaaaggtacatgcttataggcggcagcatgaaatacatattgaggctgaaaacgacggaaaacagattcaacacgatcgatcatccggatatctcccattacaggagtaaattctacctgaggaaatttttcttccagttccaggcgtatattgtgcatgggggtttcggcactgtcgaacaggaccagctgcttcaggtcgaaggtacacaactggcggcaaagttcgctgcctatagaaccggcagctccggtgactagtacgacttttcctttcagggaagcgacgatctctgtcatattgatacaaatctcctcacgacccagcaaatcttctatatgtacttcaggcaggttatgaaagttgatttttccttttttcagttcgtcgaccgaaggaagtatcaacatacgaacttttttcttctcacagtagcggaccagacgttcactctcctcctttaccaaacgatagtcggtgaacaagaccgctttgatatttttccggttaaccaaatggttaaagtctacctgctctttgatcgaataaatacagcatttacctacacgtaaacgtttataatctccaaaacgaagaaatccgcataccttatatggtaatttgtcattcaatgatgtatcaaacaagaatgttccgggtttatcagcttgataaatcaatagctttccttgatttgaggatacactattgactataatcgtatagaaaataatcatgaaaacacggagaatagtcaagagaaagaatgtcaggaacaagtcgactacggctcccaacgctaattcacgaggagattgaatcgtcgtggtcagataaaccaaaacgacaatgaagagtacctttagtaaggatgataaagccagacgccctgcttcagtaaaagcagagtgacggatcacacctttataagtctggcataaaaagaaactgaccagactggcacaaaaggaaataaataatatatgaaaaagagaatcgtctacaagctccgtccccagaatataccatagaaatgacagggaagtcgcagtagccagaattgataaaaataaatcaataaataagacgatccaacggttaaagaatttaacacgtgataatactagcgcaaaaccattgatattcataagttgtaaattaggggtattatgtgaaaaggttcgtcagtcccaaacggccaacttacataaactactgatgttcttatagttaaaggcaattggagtgactaaaaaaaacgatcgttttttttagtcactccatcttggcaaatttttgttaacccatgattgatgcggtattttgaaaaaatcaaattaaaacattggaaaacaaatagataaatttctcgaaactctttgtttttcaacaaatatcacttacatttgcagcacaaaaaaatgactagaaaaaacgatcgttttttctagtcattttgatttttagagcttttcaaagttttgcttaatttacattctgaaacacttcaatctcctatatttatgcatgacatagtctttttgaacataaaaaaccctgagaagcattataacttcccagggttttcttattaagaatctctttcctctacttatgtgtatcttccaaaataaatttaagtgttccggcgtttaccagttcttcttgagaaatggtataacctttcaacttctttcctcctgccgtcacttcctttatatagatatcttccggggtctgatgcatggattcgattaccaattctcccttcggatagaatttcttattcaagtcgatagtaactttattgaaggtcggtgaagtaagcacataatccatatctcccggacaggcaggataaaatcccatcatagagaatacagcccaggtcgacattgttccggtatcatcgttaccggggagaccgttcggcgcattgtggtaatacttattcaacaattcacgaacaagtttttgtgtacgccaagcttcgcctttgaaatagctgaacagatacggataggcaatatccggttcattagccatatcgtagtgaccttcatcaaataccatttgtagcttatcgacaaatttcttctgtcctcccatcaacttaaccaaaccggggatatcgtgaggaacatagaatgtatagttccaggcacttccttcatggaaaccgggattaggttcgaagttttcaccttgtttcgggttgaaaggtgaatagaatgttccgtcaggcaggatcggacgaagtgtaccgaactccttactgtaatagtgtttataccccattgaacggtcatggaacaatttagcatcttctttcttgcctaatgccttggcaaaccgggataggttccagtcagcgatataatattccagagcgtgtgaaacagagttatcgtactgttcacgaagaggaacatatcctttactcatataatcattattgtccggacgaagcaggttgaactcgccgggagtagtagctcctttacgcatcgcttcgtaagctgtttctacatcgaagtcacgtaaaccgcgcatccaggcatctactatatagggtatagaaggatcgccttccatagtcagagtctcacgtccatagagttcccatttaggcagccaaccgctttccttatacatatcgatcatggtacggataatatccaactgacgttcggggaagagtaaagtcatcaaggtgctaacattacgatatgtatcccacaaagagaatacagtgtagcgattaccagttgtatgaccgaccttcaggctttccatcatcggatattcaccgtttacatcctggataatattcggatggatcaacaggtgatagagagccgtatagaaaattgtcttatcatctttagagcctccttctactttaacacgagacaggtcgttgttccacatagtgcttgcggcatttcttaccttgtcgaagttaaaatcgggttgctccgtattcatattcaggcgggcattttctatgctgacgaaagagacacccatcttcacttcaatgacttcgttttcctctgtgtcataggtgaaccatacgccgatatcgtcaccgctcatttcacggttgtatttggtgtagagtttatacttgccggaatagatatcccattcggcctctacccccttcatttcacgctgttttttccagtaacctacttgtttgggggctttactcaccttcataacaaaatagatggggaaaacagcctggggattataacagaaagttcccagcagtttgcttccttcgatctccgtatcactgaccatacggacagttgctccggtttcgtttgtaagtccttcacccaggttcaggagaatattgccttgtcctttcgggaaagtgaaacggctcagtcctgtacgcatactggctgttgcttcagctttaatattgtatttggtcaggacgttaccatagtatcccggatgggcagtttcgtctttgtatttactgccgtattgcttgtagtctacattcagttcgccggctgtaggcatcagtaaaagactccccaattcagggcaaccgactccactcaggtttacatgagcaaaacctgtaaagaaatcgttgtcggatgagtagggagtcgaccaccactggctatccttatcgaagcggttactctccgaccccatcacattgaatggagtgacactcatcataccctggggacagatggctccgggattggttgtcccgtagttgctggtcccgataaagggatttacataatctaccggctgttgtgctgctgccatcaggcttccacacaataggaggctcattacttgcttcttcattcttgatttatttagttaataatttaaatatatgcgtatcgatttaccaaacgacgatctcgtccacaaagataaatccattgttggcttcgatagccttcaagcggacataacgggctttccattcaccattgaaagtatattcctggaaagatagctccggatctttgtttgatgctgttgtcggaataatgccctgagaggtgaaattggttccatcttcagatgtaagcagctccacactggccggctgatacactcccggaccgatcagttgcatgaagcgggctgaaactttatggatatcggttgtctcttccatatcgatcacacagtccaaatcgttcagatagccttgccaacgaccatccagataggttagtccaccacggtatccgtcaagcagggcattcatgccgccggccatatagccgggatatagcttactattataatgtatgagtttgttgataccgcgatgataatcgactttcttttcggtcggagtaccttgtaactctccatttttaaagatagccgctttgatataagctgaatcttttaccataatcataccatcgtaaaggaaggaagaagcggtgggaacagttccatctgttgtgtaacgaatttcagccggatacttttctgcatccagaaagacttcgatctgtttattgaccgtgtcgaccttcatcgttacttcaagttcgtcagaaagggtaaatgtattaatacccatttgttgtaattttccgatatgagcattcatgcgtggcttgaagtcttcccattcacgcttttcctgaggcgaccaggctatctcggccaaagccagggcacgcggatacatcatatattccaaatgcttttcatcctgaatatattccgtccaggtattggcttgaactcccataatatgcttactctcttcagctgtaagcgaatctgccggaaccgggttatagctatatacttttttaatcggagtgtatccgccaatggcatacggttgcgttttaggatctgcctgatagaaatcgaaatacatatagttaccgggtgtcatgattacatcgtgtcccatacgggctgacttaattccaccactttcaccgcgccaggacataacggtcgcttcaggagccagaccgccttctaggatttcatcccaaccgatcagtttacgatttttggaaatcagataatcttcagccttatggatcatataactctgaagttcgtcgacactcttcattccgttcttcttcatcaaagcctgacatttcggacaggttttccaggcacctttacccgcttcatcaccaccgatatgaatatattcggaagggaacaactcgattacttcatccagtacatcttccataaaagtaaatgactggggattaccaatacagaaatcaccattcttataaggtataccggaacaactcaattccggatatgcaaacaggacttcttccgagtgacccggaaactcgatctccggtattatattaatatgtttggatgctgcataggcaacaatcgcacggatatcgtctttggtatagtagcctccataagctcccggagttccttccggcagatatttacgatctttcccatcccaccatttcctccagtcggattctgtacggaaagccgtttctgttgtcagcttaggatatttatccatccggatacgccagccaccggcatccgtaagatgaaggtgaaggttattcaatttataaaaggacattacatccaacaatttaaagacttcttctttcgggaagaaatggcgcgacacatccaggtgcatcccacgatacttgaaacggggttcatcctgtatggtaacataaggaaaaccctgcggtgagaacaactggcggagtgtctgttcgccatagaacagacccgcttcggtagccgctttcaagtcgatacccttttcattgacagttagtcgatatccttccggatttccacctaatgattcatccacaataaaatggacatttgcaggtttttcagaagagaagactgcagcactatcagctttaaagaaacctcccgatgcgctgacctgtgcaggcagcgggattacgttcagttgcactgtctctttcggagagcaagcaaaaagaaacaaagaacacactacggtgacacctgtcatcgtcatgcgcgattgttttggcagtaacataataatcagtttttgtgtatttattcttggtgcggtaaatatacaaagaaaaagggaaaatcccgtaagagattttccctttatatgaaaagaaagccgcaccgtagatatgaacaaactccgtatgacaggatttgagtgctttgccacctttgtaatccgctgtgcgaagcatccccgaagggtgcggcccgccattagcgacaagagctgtgtctcggaattaaaataaactgatgagtttcccaatcgaacaagtgcggctaactcatttttcttattacaaagatatgtaaaggctttgaatataccaaacaaaatgctaagtatttccccttaaatattgaataaaaaagtaaactctcagtgtttcaaaacgtatgaattgcaaaaagtaaacaaaaaaagagtccccaaacgaggactcttctcctattgacattatgatatatcaattactttactttagcaacgattgctttgaaagcttccggatggtttacagccaggtcggccaacactttacggttgatttcaatacctgcagcgtgtaaagctcccatcaaacgagagtaagacataccttccaaacgtgcagccgcgttgatacgctggatccacaatgcgcggaagttacgtttcttgttacgacggtcacggaaagcataagtcaaacctttttcccaggtattctttgctacggtccacacgttcttacgtgcaccataataacctctggtaagttttaaaatccgttttctttttgctcttgaagcaacatgatttactgatctaggcataattctaatctgttttgaatgttagcgccatcttaatttttgatgatcttacttgctaaatacattcggttaataaaaatctttgtaaaactcgcttaatttaagaagattacttcatgccaagcattagcttaacactgtttacatcaacagaagctacaaggcctgtgtgagtaaggtttctcttagcttttttagtcttcttagtcaaaatgtgacttttaaaagcgtgttttcttttgatctttcctgttccggtaagggcgaacctctttttggcaccggaattagtcttcatcttaggcattttccaattttgttttaattattaaacttgacaccctctaacgggcggtttttcttattcttcattttcgtcagcctcagactcagtcttaggcttcagagttataactttcttcaccacaggttttgcaggtcctgctgcatttgccgatttcggtgcagctgccggagctcctgcttttttaggtgtcagcatgataatcatacgtttaccttccaataccggtaattgttctaccttaccatactcttccagatcattggcaaaacgaagtaataatacttctccctgctctttgaaaagaatggaacgtcctttaaagaacacatacgctttaacctttgctccttcttccagaaatcctttggcatgtttcaacttaaagttataatcatgatcgtcagtctgaggtccgaaacgaatctccttcactacaactttaactgacttggctttctgctctttctgtctttttttctgctgatagaggaatttctggtaatcggttactctacaaacggggggcgcagcattgggtgaaatctctaccaggtcaagttccaaatctccggcaattttcaaagcctgagagatcgggtatactcccggttctacattgtcacctactaaacgaacttcacgaacacgaatacgttcgttgattctgtactgttctttcagattgtcattcttcattcaaaaagatttattctcctcgttattagttatttacttattatttttctgccaacgattcatcatttcctctacttcatcgtttaaaagcgctgcaaaggtagcaattttcatcgaacctttatcaccttcgccctgttttcttacagaaacttcattattttctgcttctttttctccgacaatgagcatataaggaatacgtttcaattcgttatcacgaatcttacggccaattttttcatttctatcgtctaccaatacacggatatcctgctcttccaattgacgggcaatgccccatgcataatcattgaacttttcgctgataggcatgatacaaacctgatccggagtcagccacaacgggaacttaccgccggtatgttcgatcaatacggcaacaaaacgttccattgagccgaacggtgcacggtggatcattacgggacgatgctttttattatcttctccggtatattccagttcgaaacgttccggtagattatagtccacctggattgttcccagctgccaacgacggccgatagcatctttcaccataaaatcgagcttcggtccataaaatgctgcttcaccatattcaatcttcgctttcaggcctttttcctggcaagcttcgatgatagcggtttcagccttttcccagttatcttccgagccgatatatttatctctgtttactttatcacgtaaggaaatctgtgcttcgaagttttcaaagtcaagagccttaaagatgataaagataatatccattactttcaggaattcatccttcaactgatccggacggcagaacaagtgagcatcatcctgagtaaagccacgcacccttgtcaaaccatgcaactcgccactttgttcataacggtatacggtaccgaactctgcaaaacgaagaggcaggtctttgtatgaacgcgggaacgatttgaagatttcacagtggtgaggacagttcatcggtttcaacaggaactcttcaccttcctgcggagtatggatcggctggaacgaatccttaccgtattttgcatagtgacctgatgtcacatacaactgcttggctccgatatgcggagtcatcacctgctggtaaccgtatttcttctgaatacgtttcaggaaatcttccagtttcaaacgcaactgagtaccgcgaggtaaccacaaaggcaaacctgctcctactgcagtagagaatgtaaacaattccagttccttaccgatcttacggtggtcacgcttcttcgcttcttccagtaatgtcagatattcatccaacattttctttttcgggaaagtgataccatacagacgtaccaactgtttacgtttttcatcaccacgccaataagcaccggccacgctcagaatcttaacagctttcaagtaagaagtgttaggcaagtgcggaccacgacacaggtcggtaaaagagccttgtgtataggtggttatcttaccatcttccaattcactgatcaactcagttttatattcttcacctctgtcaccgaacattttcatggcatctgccttggttatgtcctgacgtttgatttcttcttttctggctaccagttcaagcatttttgcttcaatagctgcaaaatcgccttctttgattgtaacttcacccggatccacatcgtagtagaatccattctcgatagccggaccgataccgaatttgataccaggataaagctcctgcagggcttctgccatcaggtgggcacttgagtgccagaatgcatgtttaccttcttcgtcatcccattttaacagattcactgtcgaatcctgcataatagggcgagtcaaatcccatgtttctccattcacacttgcggccaaaacttcctgagccaaacgggaactgatactttctgcaatctgcattgcagtagtcccttcggcatactctcttacggaattatccggaaatgtaatctttatcataatctgttctctataattctttataattaggatgcaaatttagcattctttttcgtaaaataatccttttgcgccaaaagatatatgctttaaacccaaaacagacatgttttgttggcaaaccatatctgttttgaacttaataagtaatatacattagttgcttgtcatgcgcttaatgatactataagcatttataataccgagttcgccagctttgcttaggtcggcaataccctgattggcatcgcccagagataaacgtgccaacccccgattgaagtaagcttctgcaaagtcgggatcgcgcttgatcgcttcgttgtagtcctgaatagcagctctgaagtcacgctgtacacaacgcaggtttcccctgttgaagtaagcgtaaacaaagcctggatttaaacggataaccatatcataatcgcgtgtgatcatttcatgctcgtaggctctcttattctcttttacacttgccgatgaaggatcggacggtgttctcgacaaagactgattcttaccaatattgaagttcatacttcccatggaagcagacaggtcatccgttgtcgacgcctgagacatatcgtaaaccaattgcttatagcgtactactgcacggttgaaataagccattgtataggtaggatcaagttctactactttattgaagtctttgattgcttcggaaaagtcctgcaccagcatataatcgacagcacggccgaaatacgcatccgcattggtaggcctggcctctattttagcagaaaaatcattgatcgatgcaaaatgtacagcaatctgatcttccgtaagggctgcttcctcattggtgatccgaagtttacgcgacagaatcatacgggcattgaactcttcaatcatcttatcataatagacaatctttttgatcggatcaattttttcgtaatatgtcaggacaaactgaggttcgagatccacacggacattacgatcctgtacacgtccacgaacatcgctctgatatttatttctccgttcttcatctttatcatataccaccaggcgattaaacttgctgatattcttatccgatttttcacgggtattttcgtctttactacctgaagaggaagaattgttcccctgccctgttccactgtttgaagccgtagctgttccggattgtcctcctgtctgctggtttttcttggcgttattttccatttcgatagcagtccagtagtcacggtcggcacctaccgcatcgttgatcttacgtttggcatcagagcgactgaaatatccgggagtaaagttaggatactgtccgagcaccacatcgaagtcgcgtatggcaccccggtaatcaccggtttcaaaacggagtaaagcccggttgtaataggccatatagttatccggctccaactggatgactacatcgaaatcttcaatagcccggttgttgtctcctacctgatagcgaagcaaaccacgattgaagcgagcaatcaggttattcttatccatattgataacctggtcataatcggccatagcgccacgaagatcgttcatctgataacgcaccagaccacggttaatgtaatatccgccttcacgggtatttaatttaatcgcctcattcaaatcggcgagtgcatctttcaggttgtttgtctgataaagcaaaatagcgcggttcccgtaagccggagcataataaggatccatctcgattgccttgttgtaatcggcaagcgcttttacggtatctcctttctcgctatacatggcaccacgtgtcagataattcatcgagtatttaggatgcgctttcatcagcacatcaaatgtcttttccgcttcgtcataatccttccgttggatattggcaacggctttgttgacgagcatctgccggtcttcgggtttaaactcaagacctttatcataatcagttatggcctctgcatatttttcctggctctgacgagctattccgcgggcataataagcctgcactaaaaaagggttccgctgaagacataatgtacagtcttcctcggcacccttataatcatctaagttcactttagctactgcacggtaaaaatacggttccgccaaccagggcttcgctttgattacctgattgaaatactgtattgacaggacatagtcctcaaaatacaaagcattacgtcctatggccagtacacggtccgtattgatctgtgctaccagcgaaagtgaacatatttgtaatataaaaaagagtattgccttcttcatctattctaaatatcaacttgagtgaggcaaaaataagtaaattatcttacttaggctctatttttaccatcaaatgatcttttgtaattttatctccctcttttacatccaattcggcaaccactccggacaccggagctacgatacgattatacatcttcatcgcttggtggataaggagtaactgaccggcttcaacctgttgtcccttttccacatgaatcttcacaattgtacccggaagagtagaaatcacatcaccgacgaagggcttatgccacatcttacggttcttatatttctctgtaagcagcgttttgtatttacgggcggtaactacaaaatccacatattcattttctttattttccatattccaaaagtatattacggattcaattagaacggaggaattccgtgctttttagctggtctgtattcctctttcaaaacagaaagtttcaaagcgtgaagcaacaacgcacgtgtttctttcggttcgataacagaatcgataaatccttttgaagctgccacataaggattagcgaacttctcaatatactcttttactttttcctgacgcattgcattctggtcttcagcttccatgatctccttacggaagataatgtttgctgcaccttccggtcccattacagcgatttctgcactcggccatgcaaacataaagtcggcacccaggtgacgagagttcattgcaatataaccaccaccataggctttacgcaagataacggtaatcttaggcacagtagcttcagaataagcatacaatactttagctccgtgacggatcacaccggcatgttcctggtctacgcccggcagataacccggcatatcctccaatgtgataataggaatattgaatgagtcgcagaagcggataaaacgagcggctttgtctgcactgtcgcaatccaatacccctgccagtaccatcggctggttagcaacgaaaccgacagtttcgccccccatacgaccgaagccgactacgatattggcagcccacaattcctgtacttccaggaagtcagaatcatcgacaatacatttaacaacgtcgcgaacatcatacggctgcttcggatcagcaggaacaacctgttcaatgttcaacattgcagatggttctttagcttctatcgttttagcacggtctgtattattccaagggataaagcttaccaaacgttttacctgatcgaaacattcctgttcactcagggcatagaagtgagcattgcctgttgtttccgcatgaacacgggcaccacccaggtcttccatagagatatcttcacctaacacagtcttgataacattcggaccggtgataaacatcttagagatgttttccactacaaacacgaagtctgtcaatgccggagaataaacagcaccaccggcacacgggcccaggatcaaagatatttgaggaataacacctgaggcaattgtatttctatagaatatttcaccatatccggccaaagcgccaacaccttcctgaatacgggcacctcccgagtcgttgataccgataatcggacatttcatcttcagtgcatggtccatgatcttcgtgatcttacgggcatgctgcaagcctaatgaaccaccggcaaccgtaaagtcctgtgcatagatacataccggagcaccgaagatagtacctgtacctgtaactacaccgtcacccggaaagtccttcttgtccatcccaaaatcgcgaccatcatgcttaacaaacaaatcgtactcatgaaaagagttcttgtccagcaaggaaagaatacgttcacgggcagtaagtttacccatagcgacctgcttttcgatagcagcttcgcctccacccatctctacaacggctttcttctccctgagggcctgaatgtttttacttaaatctgtcatactgattatttaatagagttttattatttaccgacagcttttgctctgtatgaacaacgagcagtccctttaataatactatttagttttcctttattcaattggcgacggataggtgacacattatctatgaacacatggccttccaaatgctcacattcgtgctgtaccacacgggctgcaaaaccatccactacttcatcgtgctccaccagatccgcatccagatatttcacccggatctttttagcacgggataccttttcatgtactcccggaagactgagacagccttcttccattgaaatttcctcttcgctacgttccacgatatccggattgatcatcgcacgtttgaatcctttacattcgggaaaatcgtcccccatcacatcggcatcgatcaccaacagacgaagcgacaatcccacctggggagctgctaatccaactccgtcggcattgtacatggtatcaaacatgttagccactaattgttttaaatcgggataatctttaggaacatcttcagcctcttttcttaatacgggctgaccatataagtatactggtaaaatcataaactaaaactgatattttttattttctaaatatgattgtaggataataacggcactgatctcatctaccaaacctttatcctgtcttttcttcttctttaaaccaccgtcaagcattgccttatgtgccagaacagaagtaaaacgctcatcataatattctaccggaatatccgggatagttcgtttcagatgtgtaacaaaagcctctacatatttcatattctcggagggttcattattcatctgcttaggttgaccgacaacaaacagatcaaccggttccttagatacataaccggataaccaggtaacaagttcaccacttggcactgtcgtcagaccgtttgcaatcatttgcaaagtatccgtaacagcaatcccggtacgcttccggccataatcaattgctagtatccttcccatcggctgcaaagatagcacaaatatgcattcgtattacacaaatacataaaaagtgtgcaatttataagtttaataggcattcttttcaccttttgacatattcaaaaccgtcactacaatgatcttcagatccaggaaaaacgaccagttttcgatgtaccacacatccctctttacacggccttccatctgttccaatgtttttgtttctccacggtagccggttacctgcgcccatcctgtaactcccggctttaccaggtgacgcaccatatatttatcgataagggcagaatattgctctgtatgtttcagcatatgaggacggggccctactaccgacatttcccctttcaatacattaataaactgaggaaattcatccaggttcgtacggcgaagaaaatcaccgacacgggttttacggggatcatcttttgcggcctgtaatttatcggcatcagcattcacacgcattgtacggaatttataacactcaaaatcctgcccatacagacctgtacgtttttgtttgaaaaagataggccccggtgaagttatctttatcagagttccgatgataacataaagcacaggatagatcgtcaataaaacgcccaaagaaaaaataatatcaaaagaccgttttaaagcccggttataagcagcctgcaatggttcacggcggatagccaacaatggaatcgactccattatttccataacaaggctcttctttatattcctgtaaaactccggaacaatatagaaacgaatcatatgcttttctgcaaaattcattatccgcaatatcttttcatcctgtgttcccggcaatgtacaatacacctcgtctatatcgtttgccagaacatagtcctccacttcgtgtgtcattcccagatagtttggcaatgcactttgcaaggataagttatcatcgaaaaagcccattacattaaaaccgtatgacagatcatctttcatgacccgatacaattccataccattctttccggctccgacaataataattttcttaaagttgtatccctttctccggtacattttcagagtaacacgaaccaaaacacgccaaagcgaaaagactacaaccgtaattacataatagaccaacaggaatgtcgccaagacatcaccgatattcaggaatataagacaggtagcaaacaaaaagacctgtatagatatcagggcaaaagcacgctgaacgatcttatcgataaaaacaaccgccacatgcaattgcatggggataaaataaagagagaaaaaataacaaaaattcaatagaagaatcacctctctcaggctataagatatcgctttcgtataaaactcccccaaaccataatagacagcaaagaacagcagatttatcacaagcaaatcgcccattcctatacaccattggataaggtagccatgttttttgtcgaattccataattatattctaaaattccacaaaagtaatcataaatccgtgcaaaaaaaaggccgcacaacataatgtgcagcctttttcagatataattaaaaaataattaattatttgcagacatgataacaacacggttccagttgttttcgctatacggctgttcatccgaacctctccattcgatagtgatctggttagagttgataccgtatttttcgatcaattctttagcaacggctttagcacgtttttcagaaagacccatattatacttagagttacctgtattcttatcagcataaccgataaccttgatcggagtattgctacccttcatgaattcagcagtattgtaaatattgatctgctgattcttgtcgatcttagagctattcagacggaaatatactacattgtcaacgtaattgtttacaacagttgttaccacttcttcgcattcaggacaagactccggacgtttgcttaactcatcgttagcagcacgcagagagttgatctgattgttcaggtcattcaacaaagcgtaatccatcggttccaatacttcgaaatcagttttacccaatttgaatgtcaaacctgcacttacctgagcaataccgtcagtcaggtgatacatagaaatacggttaaactgttcgttcaataaagaagcctgaacttccacgttcaaatcaacacgtttgctcaaacggaaagcagtaaggataccggcattcaatgtaggagattcagttcttgcaaattcagcagattctgtagttttgaaacgctgtgcataaccaaaaccaacccaagggatcaaacggaatactctcttttcgttataaacaccccagaaattagttacatcccataacaaatctacgtgagcagctgcatatttattatgctgcatcaaagtagcatcggcatcattctgataaaatccatgtaaaacaccaccgttcaactgagcacggaaagccagatatggattaaaccatttaccaaatgagaactgaggagcaaaattcaaacggttaccaaaatctgctttattattctggtcacctaataaaatacttgcaccaccagcaacagaaataaaccaattgtcgccagctttgtttttcttgaaatttgtcttataccctttttcagtactaaaaccaacttgtggtttaaattcctgtgcagacacagaaaaaacgaaacctgacaacaaagccaaaagtaatactttagtcttcatattcatcaacattttaattaaacaatcaattacctcaaataacgctcaaatttagagcaaaattaactcttttttcaattaaaacaaactaaatctatattttgttcttaatttattcaaaataattcagaattttgtacccgccttcccgtaggtaagactcttttttcataagtttgatatcattctgcatcatatcctgaataagggcatcgaggctgtattttggttcccatcccaaccgggtacgggccttcgttgcatccccgataagtaaatccacctcagtcggacgaaagtattgcggatcaactccaacaacatcctctcctattcgttctttaaaactttcgaggtaagactcacccactttctctataaacattttttcgtcaatatagtttaatgatgctacctcattaacattttcacctttgaaaataacttctacgcctatttcttcaaatgctttactgacaaaatcacgaatagtcgtggttattcccgtagcaattacataatcagaaggttcatcctgttgaagaatggcatacatggcacgaacataatccttcgcatgcccccagtcacgtttagaggataagtttcccatataaacttttttctgcatacccaatgctatgcgcgatacggcacgggttactttacgggtaacaaaagtttcaccgcgtaaaggcgattcatgattgaacaaaataccgttggatgcatgcattttatacgcttcacgatagttgacagttatccagtaaccataaagttttgctacggcatacggacttctcgggtagaaaggtgtagtttccttctgaggaacttcctgcaccaaaccatatagttcggatgttgacgcctgataaatacgggttttctgtgtcagattcaacaaacggacggcttccagaatacgcaaaacacctaaaccatcggcattagcggtatattcgggagtatcgaaacttactttcacatggctcatagctgccagattgtatatttcatccggttgtacttcaccgataatgcgagtaagattcaaactatcggtcaggtcaccgtaatgaaggatcaggtttctgttctcgatatgcggatcttgatagagatggtcgatacgatctgtattgaacatagacgaacgacgtttgataccatgtacggtataccctttctttacaagatattcagccagataggctccatcctgtcctgttatacctgttattaaagcgactttactcattatactaagtttattattgtttgttcaaataccagttatacaaaagttctactccttcggcaatctctattcggtgacgccagcccagggcatgtagtttacttacatcggttaactttcgcaaagttccatcgggcttggatgaattaaaggtaagctcaccttcaaaaccgatcttttctcggatcagggtagccacatctttaatggataattcttttcccgtacctatattaatatgcgtgttacggacttcattaccatcagaacggacatctgcgaaatcgatatgctccattatataaacggaagcatccgccatttcctcactccaaaggaattcacgaagcggttttcccgttccccaaagctccactctacccggataaattccatacttttcaaggatagccaaaatatctttttcagaagaatcacctgatattccttctaccggacgtgtgttcaaatccttgcgtaacgcttcccagtcggctgtatgcaaacattttgccagatggatcttacggatcatagccggaaggacatgagaagtttccaggttaaaattatcgtttggaccgtacaaattcgtgggcatcacagcgatataattggttccatattgcaggttataactttcgcacatttttatccctgcgatctttgcaatagcatatggttcattggtatattccagaggcgatgtcaatagactgtcttccgacattggctggggagcttcacatggatagatacaggtgctacccaaaaacaggagcttctttaccttattaatataagaggcatggatcacattattctgtatcatcagattgatataaataaaatccgcacgatacacattgtttgccataattcctccgacatgagctgccgaaaggaacacatattctggcttctcagcagcaaaaaattcatttaccgccaactgatcggtcaggtctaactctgcatgcgtacgcaaaacaaagttcgtataccccttctgttgcaggtttttcaaaattgccgatccaaccaggccacgatgtccggctacaaatattttactatctttattcattcctttatcagtttcaataaatattgaccatattgattcttgatcattggggcagcaagctctttcagtttaaccgcatcgatccagcctttccggaaagctatttcctccaaacaagcgactttcagtccctgacgtttttcaatcacctcgacaaaggtagaagcttccgaaagcgagtcgtgcgtacctgtatcgagccaggcaaaaccacgccccaacagttgcacctttagtcctccatcgttcagaaactcctgattgactgttgtgatctccagttccccacgggatgacggcttaatattcttcgccacttcaaccactctattcggatagaaatagagtccaacaacagcatagttcgatttcggaacttccggtttttcttcaatactcaatacgttcccgtctttgtcgaattcggctactccataacgttccggatcgttcacgtagtaaccgaacacggttgctttttgttcgttctctacattgttaacggcctcttttaacatagccgtaaagctttgtccatagaaaatattgtcgcctaaaaccaggcaagccgagtcatttccaataaatttctccccgataataaaagcttgtgccaaaccatcaggcgaaggttgctcagcatactcaaaacggacaccataatccgaaccatctcccagtaaccgacggaatcccggcaaatcctgcggagtagaaatgatcaatatttcccgtattccggccagcataagaacggatattggataatagatcatcggcttgtcataaatcggcaacaattgtttggaaacacccttggtgattggatacaaacgggtacccgaacctcctgccagtacaatacctttcataagagcagactttttcttgtgtataatttattttaacagaggacaaatgtatataaaatattccggtttgcctttaccttaaaacctttctttcctaagctttgttacagtataaattctttaatttttaaaagttactcaatatgaatgcatttaacgaaaaaattagttccgccgtacagaattggtgggtttcacttctcctgggattactctatatcctgattgccatatgcctaatgtttacaccactggccagttatgttgctttaagtattcttttcagtgttgccatgttcgttagcggtacgctcgagatactgtttgccgtatcgaatcggaagcatatttccagctggggttggtatctggctggcggtatcattgatctgatactcggtatttatctgatggctagtccggggctaagtatgactgtccttcccttcatcctggctttctggctaatgtttagaggcttctcctctaccggttatgcaatggacctgaaacggttcgggaccggcaactggggttggtatatggctttcggtatcctggctattatttgcagtattgcaattatctggcaaccgggattaggagttttcacactagtttatatgattgcctacgcactgcttatcatcggtattttccgggttatgctctcttttgaactgagaagcttacataagagatatgaaaatagtacccggtaattcttacggataactttgttataaatagaatcctgtatatgtaataacacatttcctgttattatgtatacgggattatttcatactacagaagaacggcaactctgctacagtagagttttttccccacttaaatgggacttttcccccatatatatgggtattattccccacataaatggggtgttttccccactcatgtcaaaaaggtggggcttttgtttcacagcaataatagaactattcttcccgaacatctgctaaatatccctgtctaccattcttacctgccttaatcatttgttcaataaaaaaaataacgtagttttgtaacgctataaaaaaacgggaaaacacatttcagattaaatctaactaaaaaataatagtcaccgtgaagaaggaagatgaagaaaaggtaagcgggctaccggaaaatgcctacagagaactcaaagaaggagaagtttataaccccattatgtcacccgagaagcaatacaaggaagtgactccgtggtctgtattctgggggctggtaatggccgtaatattcagtgccgctgctgcctatctgggattaaaagtcggacaggtattcgaagctgctattcctatcgccatcattgccgtaggtttatcgagtggacttaagcgaaaaaatgcattgggggaaaacgttattatccaatctatcggagcttgtagcggcgtaatcgtagccggagccatcttcaccctccctgccctttatatcttgcaggataaatatcctgagatttccatcaacttttttgaagtatttatgagttcgttgctgggaggtattcttggtatcctattattgatcccattccggaaatactttgtttcagatatgcacggcaaatatccgttcccggaagctacagccactacgcaggtgctggtttccggtgaaaaaggcggcagtcaggcaaaacctcttattctggctggtctgatcggcggtctgtacgatttcattatagcaaccttcggttggtggagcgaaacaataagcacgcgtattgtcggagtcggtgaaatgctggcagacaaagcaaaagtggtaatgaaagtaaataccggagcagccgtactgggactcggttatatcatcggtttgaaatattccgcaattatctgtgccggctcattcctggtatggttagttattattccgttaatgtctgcttttttcggctctgacgtgctgactttaggaaatgacgcaatcacagcaacagttggcagtatgagcgcagaacagatatttactacttacgcccgccatatcggtatcggaggtattgcaactgccggtgtaatcggtattatcaattcatggggaattattcgcggggctgtcggcctggcagccaaagagttgaaaggtaaaaatacggaagttgatatggaaacgatacgtacacagaaagatttatcgatgaagatcatcacgatcggtatttttgctacgctgatcgttacttacctgttcttccacttcggagtattggataactggtattatgccttgatcggtctgttgatcgtcggtattatagcattcctgtttacaactgttgcagccaatgccattgctatcgtaggaaccaacccggtttccggtatgacactgatgacactgatcttatcgtcgattatcctggttgctgcaggtctgaaaggaactgcaggtatggtatcggcattgattatcggaggtgttgtttgtacagcattgtctatggccggcggttttattaccgacctgaaaatcggttactggctgggaagtacaccggccaaacagcagacctggaaattcctcggaacacttgtttcagccgctaccgtaggtggtgtaatcctgatcctgaaccagacatacggttttacaaccggacaactggctgcaccccaagccaacgctatggcagctgttatcgagccactgatgagtggctcgggagcaccctgggtgctttacggtattggagccgtactggccattatcctgaatttctgtaagattccggcattggctttcgcactgggtatgtttatcccgatggaactgaacactccgttgttgatcggtggagccatcagctggtatgtaggaagccgcagtaaagaccaggcacttaacacagtacgtttggagaaagggacgctgcttgcttccggattcattgccggaggtgctttgatgggagttatcagcgctgccttacgattcggcggtatcaaccttgttaatgagaaatggctggaagggaactttgcggagccgttagctgttgtaatgtatatagcattgatggcttacctggcgataagttcactgaaagcaaaaaaagaataagataaataatggatgcaccggtagttaatgttgggattatgacgcagaaggctgtctctttcgtattcaacggagagtatatccatacggagaatagtgccttcctgaccggggaacaacgagcgttgttcgtaaacgggaatattgtatacaacggcaaactgtacaaggaacttttctttgaaccggcttcaccagactcctcattcgacctgaaggccgttacaatcggagttgatttccactggcagcgccaggaggatcaacgcttcaaagggtctttgaacctggtagcaggaaatgaaggcatcgttgtaatcaacagtatcgatgttgaagaatacctcaccagtgttatctcgtcggagatgagtgctaccgcgtcgaaggaattgctgaaagcacatgccgtcatctcacgcagctggctgttagcccagatagaaaagaatttccgcttgggcaatacttcggagaaataccggagttgtcatcgtgaacatgatcagttaatccgttggtacgaccgtgaagaccatacgatgttcgatgtatgtgccgatgatcattgccagcgttaccagggtatcacccgggcctcgacaccaattatccgggaagtgattcatgaaacccgtggtgagatcctaacggatggtgaatctatttgcgatacccgcttctcgaaatgttgcggaggcgtaaccgaacagttcgaacattgctgggaaccggtgcctcgctcttatctgacagctatacgtgacagtaaagaagcctcttatccggacctgaccgatccaatcgaagctgaaatgtggatacgcaattcaccggaagcattttgtaacaccaccgacaaagagatactgagccaggtattaaataactacgaccaggaaacaaccaatttctaccgttggcgaatctcttatacccaggctgagttggccgaactgatccatcgtaaaagcggtatcgatttcggcgagatacaagaccttatcccactggaaaggggtacttccggccggatagaaaagttgaaaattataggaacacgccggatatatacgatcggtaaggagctggagatacggcgtacattatcagaaacgcatctttacagttcggcattcgtgatagacaaagaagatatccgtatcaatatccctcaacgttttatactgactggggccggatggggtcatggtgtggggctttgccagatcggagctgcggtaatgggagcacaaggatattcttatacggaaatattagcacattatttccggggatcacaaattgaaaaaagatattaaacttgaaatactaaaaaggccgctgatctcacgatagcggcctttttttgtgtttacctatcttatcggctacgagttgtagccggtttgtcttgactctcacgagctctaacggttacaaaggaacaaacaaagctacaaggtggcaaacaaaatagattaacaggtgtaatttacccacgaaaaggataattataccgataaaatggaccttactccgatcaggagagtcgtgataaaaagcttacatttatataaaaatagctatctttgtcaccgaacatttgacgggggatgctcccctgctctacttaaataagtcccgataaatgaacagctatataattctctcgatcattgctatttattttggtatcctattactcatcgcatggatcactggaagaaagagcaccagtaacgatgctttttttcttggtaaccgtaaatctccctggtatatagtttctatcggcatgatcgggacatcgctctcaggagtaacattcgtttctgttccgggaatggtgcgtagtatagatatgacttatatgcagacggtcctgggatttttcttcgggtatatattgattgccaaagttcttctgccgctttattataaactgcaactgacttccatctatgcctatctgggtgaccgcatcggacggcgaagctataagacaggagcctctttcttccttctatccaaaattgtaggagcagcagcaaggctttatctggttgtccttatcttgcaacactacgtattcagtacctggaatattcctttctggataactgtcgtaataagtatattccttgtttggctttacacctatcgaagtggtattaaaaccatcatctggaccgacacgctccaggccctctgcctggttgccatgctgatcgttataatctggaaggtgaaagatgcaatggaattgaatatggatggtatggtacaaacactggtagccagccctcatttccgtatttttgaatttgatgactggcatagtacacaacacttcgctaaacaattcttcagcggcatctttattaccatcgtaatgaccggactggatcaggatatgatgcaaaaaaacctgtcctgcaaaagcctgaaagatgcgcaaaagaatatgtacacctatggatttgccttcacaccagtcaatttcctgtttctttcgctgggtgtcctgttaatatcactggcagctcagcaaaacattgcattgcctgcactgaatgacgatatcctgccgatgttctgtacctccggaatactgggacattctatcctgatcttctttaccatcggaatcatcgcagcagcattcagcagtgccgactctgccctgacggcacttaccacctccttttgcgttgatattctgggagtagaaaaggaagaagcaaacaaagccaaacgtacccggttaatgactcatttacttatctcggtgttgtttgcaataattatccttatctttaaagccgtaaacagtcgcagtgtgatcgatgctatttacatgatcgcgtcttatacgtatggtcctttactcggattatttgtctttggcctgttcacaaaaaaacaaccacgcgacaaatatgttccttatatatgtattctctcaccactgatctgctttgctacggattatctggtgaaacaatatacaggctatgccttcggttacgaaatgttgatggtaaacggtgcaatcaccttctttggactatgggtggcctcagtaaaatataaatcaataaaagattaactaatatggaaattaaaagtgcagaatttgttatcagcaacacggatgtaaagaaatgccccgctggaaactttccggagtatgcctttatagggcgaagtaatgtaggcaaatcctcccttatcaatatgctgaccggcaagaaaggtttggccatgacttcgcagaagcctggtaagacattgcttatcaatcattttatgattaataacaactggtttctggtcgaccttcccggttatggctttgcccagcgcggaaaagaagggcgggagaatatccagcggattatcgaagattatatcctggaacgcgaacaactgaccaacctctttgtattgcttgactgtcgccatgaagcacaaaagatcgacctcgaatttatggaatggctaggagagaatggcgtacctttctcaatcatcttcaccaagatagataaaataagcaaaggacgtttgaaagaaaacctgaaggcctatcaggacaagttactggagagctgggaagaacttcctcctatcctactctcctcctcggagaagaaggaaggacgcgaagatattctcagttatattgaagatataaataaaagtttaaaaggatagaacgatccgggagcgacatggtatcaggttgcacggaatcgccacaattatgccggagcggacattctgccgctccgtaaggttgcgcttcaccaagtatagttgccgtgcgacctaagcctcctgaataaacaacaagaaagaatgcctgtgtaatttatgcctctctgtatttttctgcgtactcagcaggagataacccataaaaatccttgaaacaattcgaaaaatattgatgagaaccaaaacccaccgcatatgcaacttccgatatcgatattttcttggtacgaagcagttgggctgcatattccagtcggacattacgcagataagtacttggagtcaacctgcatatttcttttagtttacgatgtagatggacacggctgatccccaattccgcactcagcgactctatactcaatgaagagtcgctgatgtgttcccgaatgatccggttcaacttctccatcaatttatcatcagcactttttacattgaaatcagtcgtttcggaggtatgatccgtcttttctccggctttcgcaaaggcttgtctattcaataagttaataatatttgcaagcaaatatcgcagatcaaaaggtttggatatatatacatccgccccggatttcagaccttccacactatcatccaacgtcgttttcgcggtaagcataataatcggtatttgccgggtattattatttccacgcaaacgttgagtcatttccaaaccatccataaccggcatcatcacatcggtaataattaaatccgggtaactggaggcagctacttcataaccggcctttccatccatcgcttccctgataagaaagtgttcctgtaattcgttcctcaataaggctaagatatcaagattatcttctaccagcaggatggtgggttttcgtgacaaacgattatttttactaacagaatccgcttcatttttatcccatgcatctatttgaatgttcattgactcgataggcacattacagttttcatttagtggagtatcacacaattcctccgattgatagttttctcttagaaaaggtacccgtactgtaaacacactcccttctcccggaacgctcgacacatctatagtaccatgatgcaattccaccaacattcggcaaagatgaaggccgatccctgtcccaatattcccgacattgttcctttgatcaacctgataaaagcgttcaaatatcgtatgaatatattccggtgaaattccttttccattatcctgaacggtaaactccagatacatattttcagaaacagacaaatgaatctcaatttttcctcctttatttgtaaacttgaaagcattagagaggagattataaataatcttatccataaaatcaatatctatccaaaccgtatcgggtatctgttcggaaataaaagataactgaatatccttatctttccctaacggactaaaagaatcaactacgtcattgacaaaagagactacatctgtcttacgtactgcaagtttcatttgcccccgatcaatcttacggatatccaagagttgatttatcagccggaggatacgattagcattccggttcataatatgataaactacctgtctcgaagaatccgtatcttcctgtattaatttaagaagcggagatattaccaacgttaatggcgttcggatctcatgagatatatctgtaaagaattgcaacttggattgtaccaaacgttcattatgttctttttccaacattcgttgtttttccctcagacgaatcatcgtcaaacgaaaaataccatataaaaataataaggtcaacatagcataaagactctttgcccaccatgtcaaccaccacggaggtgtgatcacaatagacaaacagactgtttgctcgttttccggaaccgtataagctttcactctaaacatatatgaaccggggggaagatttgtatatatcgccgtacgattaccccggatggcattctgccaatcccgatccagcccttccaacatatattcataccttaccctttcaggagaaacggcctccagagcattaaaaactatcgacaaattattctgacggtaattaagcgtgatctcctgtgtctcggacagaacttcattcaacaggatttttccctgataagcctgtcctacttctatcttatcattaaaaacaaataatccggataataaaagacctgaaagaggtgtttccctggctaacttatccggatcaaaccaggtaatgcctcgtgtccctccaaaataaagacatcctgactgactatgagtagatgcctgaagcttaaactcctggttagttatgccatcatatgttccgtaaccaataaaacggtcctgttctttctgataaacggcgattccactattcgtactaacccaaaaattaccggatgaatccaattcaaaaccagcaattaaattatccggcaaaccatcctgtattgtatatagagaacctttctttaagtccttatcaattttatttaaaccccagtttgtgccaatccaaatattattgtccttatcttctaaaatagcgatagctgtattattctgaattaaactatctttccctgtataatagcaaatagtattactctctacatccatacaactcagaccagcatatgttccgacccacaacctgttattactatctatatacacgaaattacaccagttactcagcaaatagctatcagtatcatcgccagtttgtctgaaataagagaactgtccggtagtatgatccatgcgattaacacctcctccattagttgcaatccatacgtgcccttcatgatcctccgcaaagctagtaacatgattacaattaagttgcgattttcccccttccttataataataatgccttatgtctcctgttcgggtattataaatataaaaaccatgaaggtaagttccaatatacatcagtcctctggaatcctgaaaaagactggttattacattttcctccggcaatatacgctgctccaccttatattgattattgacatagcacaacttgaataaccctccgccattggttcctacccacaatttctgttccctgtcaatccacaatgcacctacactttgatctgttatatccaattcgctgtaagggttattctctataatccgaaagccatcttcttctgcaggtataacaacgattcctttctctacgtatccaacccaaatatttccctgccgatcctcacataaggcttgcactttacctgtcataggattaaatccgaaattctgaataccataaggtattaacgtttccttttcctcatccaataaccataatcctcctccatccgtaccgacccaaatacgctgcttccgatcttttatcaaacagactgacaaccttgcttcaggaatccgatcgcaccctttcaatggtcgtaccaaccgggttaccgggtcaatatatatcagtccataccccagtgctgctaccagaatatttcctttattatccgtacatagtgaaaagatagaatgctctgccagaatatgattagagtctgacaagttatttatgttctccaaaactgctgtttcaggatgaaaaatagcaataccattatatttactacctaaccacagatcaccattatctgcaacaaacaaggttgtaatatccatactcttcacatctggaagctcatatagaatgactgtattatctttcggttgtattcgcaccagtccacgatctgaaagaacaatccagacaaatccattcttatcttcttcgatacaggatatcttagaatgagccagatattgatacaaatctttaaagctggaagtaaattgttctgtccggtagtcgtatttataaagtccgctaagcgttcctatccagaagtttccaaaagagtcttcatacatggcggtaatataattatccggtaaagaattcttcttctgaaacgactgggtgaacattttcacatctgctcccgtaacccggcctaatccacaatctgtaccgacccacatctggtttctgcggtcctgataaattaaatggatactgttattcaataatccatcttctacagatataaagcgcatggatgcaaatagtcggctaccaggcagcaagaacaaaagaattatacacaatataagtttcttcatacaggtaacaatagttcgacacaaatgtaagtatttttccagcaaaaaacagtgcattacaatgtacataacataatctttaaatattgagacatattcttaaacctgttacaagggcctaagctctttattacacctgcagtcgttatctatcaaaacataccctacatttgtttcaacatgtataactttaaaatcattcttttatgaaaaggaaatgtagtacctttttatcgcaggacctaactaaaaggtttatgcgaaatttgactctcacagcccttttattaatagtaggactttcagcctatgcacaaacaggcagtcagatcaacggtgttgtattatcggcaacagataatcttcctttgatcggcgtaaatattgtccagctgggaacttcgaacggaacagtcacgaatgtagatggcaactttactctaaccgttccggaaaactctttcttaacgatttcatatatcggatatatggaacaacaaatcaaggtaatttccggaaaagatcattacaggatattacttaaagaagactctcaaacattggaagaagtcgtggtggtaggctatggtgtacaaaagaaaaaattagtcactggagcaacaatacaggtaaaaggtgacgatatacagaaattgaataccgtctcccctctttccgcactacaaagccagacaccaggggtaaatatcatgaaaaaatccggacaacccggtgaaggtttcaaagtaaatatccgtggtatcggtacaattggtaactcccaacctctttatatagtagatggcgtatccagaggcaacatcgactatctcaatccggcagatatcgaatcattagatgtattaaaagacgctgcttccgcagccatctacggatcacgtgcagcaaacggagtcgtattagttacaacaaaacaaggtaaagccggcaaagcgtccatacaatatgatggatacttcggtgtacaaaacgtttataaaagccagcctctgctcaatgcacaggaatatgccatgatcatgaatgaagcacaaataaactcaggactcagaccttatgattttaccaatatgatggatgcgggcgattgggagcgtattcaaaacagtagttggaaaggaacaaactggttaaaagaattggaaaatgaaaatgctccgatgcaaagccacgcccttaacatctccggaggaacagagcagtcggtctattcaatcggactttcatacaccacacaggaaggaatttacggcaaaccagtacaaccccaatacagccgttatacagcaagagtaaacacagaccatactctttataaagtaaaagatatggacattatcaaattcggcgaaaacatgtcttattctttctctgaaaaaaacggtatcggtatcggtaactttggctggaacgatattgccaatgcactgagaataagtccatttatgccgctttgggcaaaagatgccaatgggaatgagatagaaggtgaatatcactacgccataccctggaataacaggcaagccaacccgattggcgatatggtttatcagagaggtcagaatatatccaaaaatcataatctggacggaaacttcttcgcagtaatacaacccatcaaaaatcttaaattccgcagcagcttcggttttaatataagtgccaatacttacaggagttattcgccggaatacaaattaagtcctgaaaactttcgtacggaagacctcacttaccaaagttccggggtaggattaggctggacattcgaaaatacgctttcttacgcattcaatatcaaccaggtacatagtttcgacgcattaatcggaatgtctgccgaacgatggggtttaggagacaaccttaatgctaaaaatgtaaattcaatctttgatgattttgaccatgcttatatagataatgcaaatgttgttgatgcttccaaaacctctattggaggtagtccctggggcaaaggcggcatcatgtcttatttcggccgtatcaattataactataaagaaaaatacatggctacactggtcatgcgttcagacggttcatccaatttcgccaaaggaaatcgctgggggtattttccttccgtatctgcaggttgggttatgagtaacgaggattttatggaatcgacaaagagttggatggacttcatgaagttgcgtgccagttgggggcagaatggaaaccagtctatttctcctttccaatatctggccacaatctctttctatgatgcttattactttataggtacggataaaggacaaatatcacaaggtgcatttcctgacatcttacccaatcagaacgtaacatgggagacttccgaacaaattgacctgggtttcgacgctcgtttcataaacaatcggttaggtatcaatttcgactggtataacaaaaaaacgaaagactggttagttcccgctcccgtcttagccagttatggtacaggcgctccatatatcaacggtggagatattgtgaacaaaggtatcgaaattgccatgaactggaatgaccaggcaggcgacttcacctatggaatcagtgcaaatatgtcttataataaaaatgaagtaacccgtattgctaatagtgaaggcatcattcgctccgatgtaaaaatcagtaacggtacggcgagtattccccgtgctgaagtaggacgtcctatcggttacttctggggatataaaacagacgggctcttccaaaatgataatgacgtacagaattacaagaataacgacggaaaagtaatcatgccgacagcccaacccggagatgtccgtttcgtagacctgaatggtgacggagttattgatgataaggataaaacaatgatcggtgatcctaatccggatgtgttattcggattaaatctcaacttgggatataaaggttttgatctctcaatcacaactaacggttcattcggtaatcagatcatcaaatcatatcgcggagccggagacagtcctcaggataattatacaaccgaaatattcggcagatggcatggcgaaggaacctctaacaaaataccccgtattacgaatgggacacatatcaaccgtcaatatatatccgacctatacgttgaaaacggagattactggagaatcaataatattactctcggctatgacttcaagaagttattcaagaaagtccctttcgaacaactccgactttatattacagcccagaacttgtttactattacaggatattcaggaatggatccggagattggaaccagtacagatgacacaaactccggatgggctagtggtattgatgtaggattctatccgttacccagaacatatatggttggagcaaatattaaattctaaattaaagacaacttatgaaacgactatttatatatattatagcatctgcatccttcctgaacacaggctgcagcgactttctggatacagataacctgaccaagaaagacaacacaaatttccctatgtcaccagaagacgcaacacaatcgttatatggtgcctattcaacaatgatcacttttgatgccaacgaacatccttttatggtagcggaactactatctgacgatcgtttcggcggtggcggacaaaacgaccgcaacccacaggctcttaatgtattcaaagcgacttccgagaatcagttgaaaggagcctggagtaatctgtacaaaggtattttccggtgtaacatgcttctgaccaccctggaccaagttccttcctgggaaagtgaagctcaaaaaaataaaataaaaggcgaagcatgcttcctgcgtgcattcttttatttcaatatggcacgtatgtggggttctgtacccttggtgatagaaccaatccctcagaataatccgaaagcaactccggaggaattattcgcacagatcttccttgatttgaaaacagcaatcgaaaacttatcgcccgtccaacagccggcatccgaattaggtcgtgctacgaaatgggcggcagaggctttaatggcacgcgcttatctattctatgacggatattataatcaaaacgcccgtaaagaggtgaaacttgccgataagacttccatcaatcaagcaaatgtcacagaatggttaaatgattgtatcaataacagtggtcacaaactagcttctgatttcaggaatttatggccttattctattgatataccggaagctgattacctgtatgccaaaaacaatcatttgagctggctacgggaaacaggagacaacaaggaaagcatattcgttggaaaacattccatattaggcagttgggatactcctaactctgataaatatagcaatcaagtcaatatttatatgggattaagagatcagacactcgtacctttcggacaaggctggggattcggcccagtggttcctacattatataatgaatgggcagataatgacctgagaaaaaaaggctctatctgtaacgtcaatgataccgaagaaaacttacctgattataaatggggaggtgatatgatgtggcaggaaaccggcctttggcaaaagaaatatattccgatcaatgtacgccggaaaaacgcctccggcattgaagagatctgtaattacagttgtgttttatatggcagaactcctaatttttcacaggataacacgcaagatattgtctacatccgttttgctgatgtattgctgatgcatgccgaattaaccaaaacgacagacggcatcaacaaagtcagaagccgtgtaaaccttgaacctatagcagcctatagcgatgaaaccttacagaaggaaaggagatacgaactggcatttgaaggctgtcgctattacgatctgctgcgttggtatggtaaagaagccggtgtcatcatgaaaaataatatgaccggatctaaaatatggaatatggcacagccaaccaccatcaaccaggatcgtggcaacgactatttcaacaatattgaccaacgggttagagaaaccggcggtttcttacaaatacctaacgaagaaataaccttatccggaggagtcttaacacagaatccgggttgggaaggagcttccgttatgttctgataaaatatttaccaataaacatagtatcttatgaaagctaaaataatatttctgttcttattattactgacaatctttacagcctgtgaaccgattgaagatcggcaagatgcagggaatgtattaaaagagagtgaactaattttcaatattattcaggaaacgacaggaagcaataccgttatattcgaaaacaaaacacagggaatcttgcctttcttcgactggggctccggtttttctaataaaacacaagctgaggcttatttcccatttgccggaacctattcggtaaccttcactgcttattgtgccggaggtaatatcagtacaagcaaagagtttactgtcaaccaaaatgatccggtctatttcaatgatccggcatggaatcttatatctggcaacggcagtggcaaaacctggatatttgcaacagatatcccttcctctaattttggtggaaggatatggggtaatggcggatatctcgatatcccttccggccctaactggtggggacggactttcgaggatgccaaagatgacggaatagatctcaatgccgagttatatttcgacctggacggtgcggctcacatgaaaacaatcagtaatggaaccacaactactggtaattatgactttaaactgaatgaaaaagtcatgaccagtgatggtcagatatgggccataggaagtatcgaattctccggagccaccattcctcacggcattagtcaaaacgaagggcaaaaacctgtgtataagtttgatatctgtacgttaaccgaaaatgaactggtattatgttacaacacagaagggaatagaacccagggctgtgaaagctggtactggcgttttaagagaaaagggtttaattattaatcaatgataagtcagacatctgtctcatatgatgaaaagaattataatcacacttttgttttgtttgccgttatatctcacagcgcaaaatcagttataccgtagtcctgaagccgaaaagttatatcagctactaaaacaaatagtagacaataaacaaacgatgtttggaatggctaaccctacaactataggttatgcatccggacctttgaacggtgaatataaccattcggattgtaaagatatcacaggagatcatcccgcttttcacgaaagtgacctgatgtggtatgaagggagtcaggaattccgctcctgggatataaaagccatgaaaaaagcgtggaaaagaggtgccatactaggctattgctggcatattggaggtcctgtatcgcataaattttatgcgatacaagatggacaacccagtcaggactatcatttggctactgagataatagtgaatccggaccggacaaccaatataaaactggattggtatctaaaccggattgactcgatagccattccagtcttcaaagaactggattgccccattgtctttcgtcccttccacgaaatgaccggtgattggttttggtgggggcgacagataggagctgatacctatattaaattattccgtctaacagttgattatctgcatagcaaaggtattaataacctgctctattgctggtcacccgacaaacaggtcgattttactttctatccaggcgatgattatgtcgatatattgggattagatgcgtatgaacccggcctcaccacgcattatccgatcccggcattagtagaaaatctgactaagatatgtgactatgcagaatcgcataataaagtcgccgcatggaccgaagtcggttgccgtcctactgaagaaggagttccccgttatccggaacaatatccggatttctggacaacttatgtttgggatatccttaccaaatatccggcagcagggcgtttagcttggatccttagttggtataatgctgactggaaaaaggatttttcttcatctccttatattccctataaaggaatggataaaaaaaacagttctgaagccatacaggatttcactaaaatgtatgactactccaatagcctgtttgagaaggacatgaaaaacttcagaaaacaaaataagttataactgatcaaattactatcaataatatgagaaaatatttattcttaatcgtactatcctctatatgcctgcttagttgctccgaaaagtccaatatatataatgtacgcgattacggagcacataatgacggagaaacgttgaccactgaacagatacagaaagcaattgatgcatgtgcgcaaaacggcggcggcatggtctatatccctaaaggagaatttctggttggcaccttgaatcttaagtcaaatgtaaatttccacatggaaaccggtgcaatcctcaaagctacaacggatttaagtcaatatcagatacacaaccaatatccggcaggaatcttttacaccgagaaagcgaacaatgtatctataaccgggaacggggttattttcggacagggaacggagtttatgtatgccgatagtgcaaaagtgattggcgacaaaagttatacccgtcagaaagataatttccgcaaagtttcttccggaattggggatggtcccttatacccgaaagaccgtttccatcaaatgatagtattcagtgagtgctccgatttgactcttaccgatttcaagtgtgtagatgctccatactggacctttgtgatcgttcattgcgaagatgtcatttgtgataaactcaaaatcgacaacaacctgaatattcctaacagtgacggattggatataatatcctgcagcaacgtaaatgtatccaattgtattttctcctgtggagacgatgctattgtactggccggatacgcccaccattatggagatccgggatttaaagatatcctgaaacgttcggagaatataaatgtaagtaactgcgtgttccgctcacgttccagcgctatccgtattggaggttgggatcaaaatcatatgtcaaattataacttcgacaatattctgatctatgattctaaccggggtattaatattggtgttggagattccggctctgttcagaacgtaaacttcaacaacatccgtatcgaaacccgattgcatacaggtgattggtggggacaaggcgacccgatcaagattacagccatgcgaggcgttgcggacaatcctatcggcatcatcaggaatattaacttcactaatgtttcatgtcgtagcgagaactgtgtcaatatgtacgcttcgaacgaaacacggttacaaaatatattctttactaatttccaaatggaattcgtcaaaagtgataaagaagaaacttgtggaggcaacattgacttacgtccgaatattgttcccggtaaagaggtttttgcccgaaacattcctgctatttacatagagaacgcagacaatgtattttttaatcaggcagaaataatatgggacaagaatattaaccggaaacattacactaacgcaatcgaggctataggcgtgcacaatctcaggttgaacaatacgctcgcctccccttctccctctaatccggatatagcgaccgtcctcttacaaaactgtacagggtttaagactgatgatacacaaatgaaagtttcccggattaattaaaaagcgacctaagcttcctgaataaaagtgctattttatagcttctttccaaaaaataaatacatttgtacttcatcaaaaccgaaaggagtaaagatatgaaagcaatggaattacagggtgtgtctgggactgttcaacgaaatcgtcaaccttgacacagagtatcgagaaggtaaagaagtacattaaacgtatcgcatccaacagatacaaaatatcacgtgctaataaagtggatgacatcgacatcgtcactgacgaagaaattgaaaatgctatgtgcccatttactgacgaggagaaaatagaaagattaatggccgcagaagccgatcctgtttattatactcatgaagaagtaaaaaaagctgctgcttcatggataaccaactaagataaaaaaggaagccctaacagcttcctttcttttgctattatatcatccttccaatgcctctttcagcttagcagtcatccccacatactcatcttccgacaaataaaccttctgagggttcattgcgaatgtaccgccaaagtcgggaccatcctcatatttgggagccagatggaaatggagatgtgaaagtttgtccgagtaggcaccatagtttatcttctgcgggttaaagaccttctgcatggcacgtgtcacccttaccacatccgccataaacgcattccgttcctcatcgctcaacatattcaggtcatgtacatgatctttgtatgcaaccaggcaacggccataataggtttgttccttgaaaaggaaaagccgggataccgataacggagcaatttcaatcatcagattgttcaaagtctggttgttcgcgcaatacaaacaatccttgggatcacttaatttcatgttatatcagatttcatttattattcccgcgaaagtaaacataaagcccggcaaaagcaagaaacttctaccgggcttttatacataccaatatgataattttagtaactaatcttacaaccgatgaaataactacgcggaatacccgggccataaatatatcccgcatcccgctccggccccttatcaaagtcatcctgataagagttaaatatattctgaacaccggcatttacctgtaaagtaaccgatttgtaaagagggaaatcataagccactttcacattcaggtcaaagaaatcctttgtcttttcttccttatcctccggtatataaccagccaggtgttgaaccagcatactaccggtataagtacccgtcaacgaagcagtcagacgctttaccggagtaaatgaagaagtgaaataaccgtacacatccggcgaacggaacatcttcttctgaggagctatattttcattttcactccatgtttccggctctttataacgactacgctgaacggttgcacccgcctgtatctgcatccaggaatatacagcctttgcctccaggttaatacccatcacgcgggcacctttaccattacggcgttccatcaacaggttgttatcgtcatcacgtcctatttcttccagaataaaaacattccgcaagtctgtgtaaaaaccttcaacaaggaagtttgtctgcaccggaccgaagcgacggtaaaagtcagcagacacactaacactctgcgaattttcttctttcagatccggggatatctgtatgattgccacatcaccaccaacagccgtgatatgtaaatcttcatcaaatgcctgaggagcacggaaaccacttgaataagacatacgcaggtttatatcgctggtcgggttaaaacggacattagcacgcggactgaatatcgcatggtcgatcaggttatgtttgtccatacgcgcaccgacaagaaaactccatttttcattcttccattcgttctgcaggaagacactaccgatatgtaccgtctgttcgatcgtacgatgatagcccaacatcttgtcctgcaaatcatcatagttatactcggctccaccggtaaactcggctggcataaaaagacatttttcccactcatatgaatattgcgcaccacccacaaaagtcatatccgttgtgctgccatacgcattcgggttctttccggcaccataataactgtttctctttgtatgctgggccgaagtatacacattcaggcgatgtttgtaatctttcgaaaacaagtcgaacttcaagccgccaccattaatattgtgttccgtctgctcagcgatattcgcttcatgaggaggtaaatccaacaggtcaccgccacgacggtattcgttgatgttatggtactcgaaagtcagcttcgaataggtacttgttttcagataggaacgaaagccaagtgtacgggcattcagttttccgagttcggtatatccgtcgccatcatggtcataagcaccacgataacggttctgcccgaacatatagataccggctttatggtcgtccgtaaccagcgaagcatttatcgtcgtattgttatccggacggtcgccaccaatcattgtcaacgagtgggcgatctgtgccgaatttctcaacggttccttagtgataatattgattgttccggcaatagcagaagaaccgaacagagccgatccccctccacgcatgatctccacacgttcgatcatattagccgggatctgttccagaccatatacaccagtcaacgcactaaagataggacggctgtctaccagtatctgcgtataaggaccttccagaccattgatacgcacctgctggaaaccgcagttctgacagttgttttccacacgcacaccgggttggaaattcagaccgtccgccagagaagtcgcatgtgtagtctcgaatgttttcgaatccagcacattcaccagagaaggagccaacctgcgggtcgtctcattccggttggcagagacaacgacaccatccaaagagacggcatcctcttccacttcgagatttacttccagtgttttacctttcttcaaggtaaccggtttctctacagttttatatcccaaggttttcattaccaatgtgaactttccttcaggcaggttcttcaaataataatgtccggtagcatcggtcgtcgtaccaatagtcgtaccttttagaaagacagtgataaaggctaaatgttctcctgtttctttatccagtatatgccctacgatattggcatccgaagggttcagggcaggagtatcatctccccatgctgatgtaacgacacagcacaggcatagtataagtataaaaatcttattcattgcaatttgttctgataaatatattaatgtactaatctgcggtcgggcatcttctgattgaaagtacccgatgctttatattttatcagacaacaggaggggcacggagaaaaatcttccccttaacagggaccagacaatccggacagaccggcatttctactatttcggcaatttgtaatgcatggaaatcaagatgataagcatgaactgcaccatcttccacactgatggtagtcagtatgtgaaataattgtatttcagataaggatgcatgatgatggcaaacaccgccactcacctttccaaaagggtgcgaatggacaattgtggtaccgttctctatatggacatggataaataaagtaatactgctataatacgcaatgaagatcaccggtagcagccatttcatatatttacccatcctttctttcacacccatattcttttaagaaggcgcaaagttacaaataatttttatacttttgttcttatccataataacaggatgatttacaaatagaaatagtatgacgaaaagagaaaagccgggtagcacccctaaagaatatttgagtaaaaagcatgaatctctttatatgttgttcgatacctattgcgaagctcatagcacttccaatatcagtctgattgaatctcttcaggagatgccgttagacgaattgatccgtaaacacaaaaaagtagcatatgactttctggggagtgatatatcccaaaagaaaaaacagatctggataaataagatttattccgattgcaatctgacggactacgaaccgttactgaacctgctcactgaagattccaaactaattcgaagatacatcgagagagtcataagtaccaaagagaaaaagacccgtgaatcgatagaacaaaaatttccgaaacttagcgaagaagcccagaactgggccaaacaattgttcaggttctgggataatacgcatgccaaagctaaaatcaaattcaagaacaaaaaggaaattatcgattactgcagcaaacacattgagctttaccgtaccatgcagatagcctggttgccgttaaagccctacacgatgatcccgtggtcagacagttgcgattttgtgccacgcccggttgtccgctacatattaagtgaatatatggcattcccccaggctatccggttaaaagactgcgactcgatcgttccgtttttcaatcagccggaatggtatgcctcactggagcaactcttacagttctggctggatgatggtgcagaggccaacaggaaaggtattctggctccttattgtttctatggtagcgaacaacaactcgaacgcttacataccttattaaagagttggctgaagaaaggccgcaaaggtcttgtcagctatacgcttggcctgttagggttgaaggctacgccccctgcactgagaattcttgatgaatggatcgaactgatgccggagggaaaatacagacgtgaagccctgaaagcattccaacaggtcgcaattcaccggggtcttacaatcgacgaactggcagaccggctcattccaacattcggtctcaatcgcctcggagaaaaagagatcgattacggtcaccgtatcttacgcctgacactattgccggacttttcgatatccgtcttcgacgccaccaaacaaaaaaccagtaaatccctccctgctcccttgaaacatgacgataaggaaaaagcagaaaaagcaaaagaggaaatggccggtctgaagaaacaggtcaagacacaaacaaccgtccaaaggagacggctcgaacaagtactgaaaaacggacgaacctggcctgccgagacatggcaaaccatttttgtcgaaaatccgatattccgttatataacaaacggcctgatctggggtatatataaagaaggccggttacaggaatctttccgctatctggaagacggaagcctgataacggcagatcaaaaagaatttatccttcctgcaaatgccgttgtttcgctcgttcacccggtagagttggacgaccacctgacaaaccaatgggaaaagcaactgcatgataataggatcgaacctttattgcctcaactagctactccggttcatcgtttaagtgattcggaaaaacaaggtaacgaaatctcccgttatgccggaagaacggttcgactgagtagtatatacgaatttgaatcgagagatctgatttcccggatagaggaacaaactctttatatcatagacaagtcgttggatatcgccgcacggcttcctttcgaatatgaagaaaatacctgcactataaaagagttatcgttctctccttacaaagaaggggccgacccagacacgatcgagctacccgaagacgagagaataccgatctcctccattcctgaacgattcatcagtagtttacttgatgtattagtcaaagtttttgttttgtgagtgcaagattatacgaatttaacaccaactaattgtaagcaatcagcaccagatatctaataatttgttacttttgtagtcgttttcaaaacatgtattaaatatactaatatcataagtctatggcaaagattacaaaagaagatgcactacggtatcattcggaaggtaaacccggaaagattgaagtaataccgacaaaaccctatagtacacaaactgatttgtcgctcgcctactctcccggagtagccgaaccctgtctggaaatagaaaagaatccgcttgatgcttataaatatacgtcaaaagggaatttagttgctgtaatatccaacggcacagccgttttaggtttaggtgatatcggtccgcttgccggcaaaccggttatggaaggaaaaggattactgtttaagatcttcgcaggaatcgatgtattcgatattgaagtgaacgaaaaagatccggagaaattcattcagaccgtgaaagctattgcccccacattcggaggaatcaacctggaagatatcaaagcacccgaatgtttcgagatcgaaacccgcctgaaagctgaattggatattccggtaatgcatgacgaccagcatggtaccgccatcatttcagctgccggcctgttgaatgcactggaactgacaggaaagaaaatcgaagaagtaaagatcgttgtcaacggtgccggagctgcctcgatctcctgtacaaaattatatgtattgttaggagcccgtaaagagaacatcgtcatgtgcgacagtaaaggggttatttctacccatcgtaccgacctgaatgcagccaaaaaggaatttgcaaccgaccgggacatcaaaacattacaggaagcagttgccggttgcgatgttttccttggattgtctgttgccgatgtattgactcaggacatggttcgcagcatgaatgaaaatccgatcgtattcgctttggctaatccgaatccggaaatttcctatgccgacgcaatggcctcccgcaaggatatcatctttgcaaccggacgttccgattatccgaaccagatcaataacgtacttggattcccgtatatcttccgtggagcattggatgtacatgccaaagcgatcaatgaagagatgaagctggctgctgttcacgctattgccgaattggcgaaagagccggttcccgatgttgtcaatgcagcttacaaactgaaacggacctctttcggacgcgattatatcctgccgaagccgctcgatccccgtttattgacacgtgtatcagtagccgtggccaaagccgctatcgaatcgggggtatcccgcaaaacaatcaccgactgggatggctatgccaaccatctgcgtgaaatgatgggatacgataacaagatgcttcgttcttttaccgatatggccaaagccaatccgaaacgtgtggtattcgccgaggccaaccatgtcaatatgttgaaagctgccgtagaggcaaaagccgaaggtatctgctacccgatcctcctaggcaacgaagaacgtctggctaagattgcggcagaagagaacctgagtctggaaggcatcgagatcgtaaacttacgtcacgaccgcgaagaagaacgccgcgaccgttatgcccgcatcctatcggaaaaaagagcacgcgaaggcgtcactttctccgaagcacgcgaaaagatggtcggccgtaacgcattcggtatgatgatggtggcaaccggtgatgctgatgcatttgtaaccggtgtttacagccgctattcggaagtgactaaacttgcagaagagattatcggtatccgtccgtcgtacaagcatttcggagctatgaacattatgacttgcaagaaaggcactttctttatatccgacacattgatcaaccgccatccttccaccgaagtattgatcgacatcgcccgtcttacacatgatgcagttaagttctttgcacacgatccggtaatggccatgttgtcttactccaacttcggctcagataagcaaggtagcccgcagaaagtacacgatgcgatcgattatctgcacaaaaaccatccggagatcatgatcgacggagaaatgcaggttaacttcgctctcgataaaaagctgcgtgacgatatgtatcccttcaataagctgaaaggaaaagacgtaaacgttttggtattccccaacttaagttctgccaacggtgcttacaaattattggatacactgggcatcaccgaaacgatcggcccgatccagatgggtctgaacaaaccgatccacttcaccgatgtagaaagctctacacgcgacatcgtcaacctgacaacggttgcagttgtagatgctatcgtacaggagcagattgagaaaggagaataaataatagtaacaataggtttctattttactaaaacataagaaagtacggggtaagacatttactccgtactttttctttttacaggtatttactccttttctactactattctccacctgttcacccgtctgtattcactagatgtaataaatccgtaaatcaggtaaatctatcattgattttggtacaaagccgcttgctttaatcctttaattttgtaacatgaaacttataaagaattactttacacaattaaacattaaaagtatggcaagaaattcattcaggaaactacgcatagcaatggtcgcatgcttttgtattgttgcaacgatggatgcatccgaaacagcaagtaacaattttaatacagatataacgatggacgaaaatcagaatttaacgcaggtatgggacaaagtattcccacaaagcaacaaagtaaatcacagtaaagtatctttccgcaaccgctacggcatcacgcttacagcagatttgtatataccgaaaaatgcagtcggcaaactagctgccatcgctgtctcaggcccgttcggcgcagtaaaggaacagtcgtcgggtctttatgcacagacgcttgccgagcgtggattcctgaccatcgctttcgatccttcatatacaggcgaaagtggaggcgaaccccgatatgtagcttctcccgacatcaatacagaggatttcagtgcagcagtcgattacctctcgacacgcgacgacgttgatcccgaacgtatcggtatcctcgggatctgcggctggggtggcttagccctcaatgcggcggctatcgatacccgcatcaaagcaacggtaacttcgacgatgtacgacatgagtcgcgtcaatgccaacggctatttcgactcgatggatgccgatgcccgttacgaactccgcaaacaactcaacgctcagcggacagaggatgcaaagaacggtacgtatgcgcttgccggtggtgtaatcgatccgctacccgccgatgctccgcagtttgtgaaggactactacgactactacaagaccgaacgcggttatcatccccgctcactcaactcaaataatggctggaacaaaacatcggctttgccgttcatcaacatgccgctgctttcatacagcgatgagatccgcagcgccgttcttgtaatgcatggagagaaagcccactcccgctatttcagcgaggatgcattcaaaaagttacagggcgacaacaaagaactaatgattatccccggagcgagtcatgtagatttatacgaccgcatggatataatccctttcgacaagatagaaatattcttcaacaactatctgaaatgatagatcgatgaattcttgttaccgccgtagctgttacggcggcaactaagatatacccagcaattccacctcgaagatcaatgttgaaaaagcagggatcggaccggacggacgattgccatatcccaatgtataaggaatatatatgatccacttatctcccacatgcatttgttgaagagcctgttgccatccttctatcacctgattcaggcgaaacgcctcagggcagttgcgctgccgggagttatcgaactcacgaccatcgatcaacgtaccgcggtaatggacggaaacgacactgctcaattgtggagaaacagaacctgtcccctgctccaccactttatataacacacctcccggtaactttacaacgccttcctgcaaagcaatctccgtcaggaattgaatattcttttctttatactcttccttcttatttttggccatatttccttcctgttaatttcactttgtcggcaaagataacccatttcatttaaaaccaatcccttccttttgctgttatgaattaaatctaaacaaaaaattatgcacataagtacatggtgttatgctatgctctgtctttttttcccaatgacgctagtggcacagacggagcataagtacctcgatcacgcattgccggaagcgtggcaggaaaacgacagtaatttccaacagactctccccgttgaagataactggtggagaaactttaatgatccggtattggactccctgatcgacgtagccgtgaaacagaactattctgtgcaaatggcggccgatcgtatcgctatggcgaaagccaatcttcgtatacagcaaggtagctacgcacctaccctcggactttctgccggatggaaccgacagcagaccagcggcaacaccggtagcctgccacagacaacgagccaatatgccgatgctgcactctccatgagctgggaactggatgtattcggcagtatccgtaaccgggtgaaagcacaaaaagaaaactttgcagcgtcgaaagaagagtataatgccgtgatggtttccctctgtgcccaggtggctacggcttatatcaatctgcgggagatgcagcaggaaatggaggtagtgacacaaaactgcctgtctcagcaagccgtcgtagagatcacgaagaaaagatacgaaaccggacttgtctccaagctggatgtggcacaggcgcaatcggtctattacagcactaaagcgtcattgccggcactggaagcaggcattatccaatataccaattcgctagccgtattgatgggattatatccccaagatgtaaaacatctgatggatacacctcgtccattacccaattacatcgagacggtcggcatcggtatccctgccaatctgcttctccgccgtccggacatccgttcggccgaacgccaggtgaatgcacaggctgccactttgggagcatccaaatccgactggtggcctcaggtctttgtcaaaggttcgatcggatttgcatcgcatgatatcgataagattgctaatcacaacagcctgacttacgagatcgccccggctatctcctggaatttctttcagggagggaaactggcacaatccacccggcttgccaaagcccagctggatgagacgatacgccaattcaaccagacagtgctcacctccgtacaggaagtcgacaatgcaatgaatgcctataagaactcggtcaaacagatcgtcgccctccgcgaagtagtcaaccagggacagcagacgctcgacctctcgctcgacctctataaacagggactgacgcctttccagaacgtgctggacgcgcaacgctccctgctctcttacgagaatcaactgacgcaagcgaaaggctcctcgctgctcaacctgataatgctatatcaggcgctcggcggaggctggagtagtgattgagatcctgcatcaaatgattttgccacaggcatggcagagccctgccatcagcttggcagagtcttgccacaggcttggcagagttctgccataggtatggcaaaacacaaagtcagttatccaataacgccgggatgaagagatcatccacaaaactaataattataaatatgaatacaacaactaaaatcgccctggtctccctgtctctccttctgctggcatcctgcaaagggaaaaagcagccgacagaaatgccagccccgtccatcagcgtaacaacaccggagattaaagatattacattgactaaagattatccgggttatttaagctccgagctgatggtaaacctcgtatcccgcgtaaacggataccttcagacttcacatctcaaaccaggtagtaaagtccggaaaggagacctcatcttcgtgatcgaaccggatacctataaagataatgtaacccaggcagaagctgcactgaaaacttctaaagctcaactggactatgcccagagcaattatgagcgaatgaaagaagcggccaaaagcggggcagtcagccagatccaggtcttgcaggcccaatcgaccgtggcagagatggaagcctccgtacgtaattcggaagccgaactgaatactgcccggactaatctgggatattgctatatccgcgccccgttcgacggacggatcacccgcgccagttacgatatcggtaattatataaacggagcggcccaacctgtcacactggccactttgtataaagacgacctgatgtatgtaaacttcaacatcgaggacaaccagtttatgaagatgatgatcacagccgctcagaacgactccaccgtgaaactgcccgaaacaatctccgtacatctgggagataacggacggcaaaactacacaggccggctggattacctttctcccaacgtagacctgtcgaccgggacactgaatgtccgtgccaatctcgataacaaggacggggaactgaaaagcggattatacgtcaccatcaccctcccttacagcgagaagaaagacgccgtcctggtgcgcgatgcctccatcggtaccgaccagttgggaaaatacctttatatcgtcaatgattccaatatcgtacgataccgccatatagaaccgggacaactggtggacgacacgctgcggcaggtcatcagcgggatcggaccgaacgaacgttacgtcactaccgctttattgaaagttagagacggaatgagtattacccctataaaataagaacgtcatggtaaaattctttataaacaggccgatctttgccaccgttcttgccctgatcattgtggtagcgggattggtcacactcaacgtattacccatcgcccaatatccggatatcacgccgcctaccgtacaggtttcggctgtttatccgggggcagatgcacaaacggtttcacaaactgtcggtttaccgatcgaacaacaggtgaacggggtggacggaatgctctatatgagctccaattcctccagctcaggcgcctattcactgaccatcacatttgcagtcggtacggatatcgacatggcgaccgtcatggtacagaaccgcgtcagcatcgcgcaaagcagccttccggaagccgtgatcgtacaagggatcactactaaaaaacaatcgtccaacatcgtaatgatgctttcactgacctctaaagatcccctctatgacgggctctacctgagtaactacgccagcctgaacctgaccgaccagttgacccgcctgccgggtgtaggctcggtcagtgtcatgggagccggtagctacagcatgcgtgtctggctcgatcccgaagtgatgcgtatccgtaacctgacgcccgacatggtttttcaggccatctctacgcagaacaggcaggtatccgccggttatgtcggacaaccgatcgcgcaggcaaataatccttatcaatataccctgacggtaaaagggcggttgaccactccggaagagttcggaaatatcatcctgcggaccgaacaaggcggaaaaatactccgcctgaaagatattgcccgtatcgaactgggcagttcttcttataatgtgacctcccagttgaaaggacaacaggcagcagcgattgccatctaccagctaccgggttccaactcgctggaagtatccaaagccgtacgggcaaaaatggaagaaatagccgccaccctgccgcaaggcgttgagtataacgtaacgctcgacacgacggaagtcataaacgcctccatcgatgaagtattagtaaccttcctggagacaactgcattggtcgtcctggttatcttcctgttcctccagaacttccgggcagtgattattccttgcctcaccatccctgtttcattgataggaacactggctgtaatgggggcactgggattctcggtcaacaccctgacattattcgggttgatcctggctattgccatcgtggtagatgatgcgatcgtggtcgtcgagaactcgtcgcgatacatggatacggggaaatatacggcacgcgaagcagtgaccaaagcgatgggcgaaattgtcggaccgatcgtaggtgtcgtactggtcttattggcggtatttatcccgacgacctttataggcggtatctccgggcagctttacaaacaattcgccctgaccatcgcagccgcaaccgtattgagcggcatcaactcgctgacattgacaccggctctctgcgccttgttcctgcaagtcacaaaagaaccgacatttttcgtgttcaaagcattcaataaagtatacggcaagacacaaaaggtttacgacgacgtggtcgatcgcatgctgaaacatcagatcgtcacactggttatcttcctgatcgtctcagccgcagcagccattctgttcattcgctggccgtctaccttcattccggaagaagacgacggttacttcctggtttcaacccagttgcctccggcatccagtctgccccgtacacaagaagtaagccggaagatcaacaagatactcgacagttatccggaagtcaaaacctatatgggtatcagcggtttctccgtgatgggaggcggcgaattatcgaatgccggaacctatttcgtcgtactgaaaaactggaatgagcggaaagggaaaggccatacggcacaagatgtcgtcacccgcttcaatcgggaagcctatggcatccaggaggcgcagatatttgccctggtccctcctgctatccccggcctgggcgcttccggcggcttgcaactgcaactggaagaccgcaagaacctggggccgaccgaaatgcagcatgccatcgagacattgctggaaacctatcataccaagccccaactcttgaacctgtccagtatgtatcaagcaaatgtacctcaatacaggctgaacatagaccgtgataaagtacagttgctgggattacaattgagcgatgtattctcgacgttgagttattacatgggagccgcctatgtaaatgactttgtcgagttcggacgtatctaccaggtgaagatcgaagccagcggacaggcccagaaagtgattgacgacgttatgcggttaagcctggagaatagtgccggcaaaatggttcctttctccgcctttactgaagccgtacaacaattggggctggaccagatcaacctgtataatatgtattcttccgcctccatcacctgtatcgccaacccgaaatacagttccggagaagccatacaggccatggaagagcttatacaggaacaactgggcgataacttcggttacgaatggacctccgttgcctatcaagaaacgaaagccggatcgaccacgatcctgatcttcggtatggcattactggttgccttcctcgttctttcggcacagtacgaaagttggacaagtccgctggcggccatcctgggattgccgatcgcgttactgggtgctattctgggttgcttcatcatgggcgtgcctgtcagcgtctacacccagatcggtattatcctattgatagccctctccgcaaagaacggtatcctgatcgtcgagtttgcccgcgactaccgtgccgcaggtaattccatccgcgaatcggccctcgaagccggacacgtccgcttgcgcccgatcctgatgacctcgttcgctttcgtattgggtgttatgccgttgctgttcgctaccggggccggagccgccagccgtgtctcattgggtgcagccgtcgtattcggtatggcgatcaatacgatcttcgccaccgctttcatcccaagcttctacgaatggatgcaaaccatacaggaaaagtggctggataaatccgacaaacctaaaacggatattaaatcctgacataaaaagaggatatttcattcaaatagtaacggttgccccgatctgttcggggcaaccgttattcttttcctccggctcataaaccacgcctatttacacatcaatatttactatttgatacctgcttaaaaacattttatatttgttcaataaattaaaaacaatacttgtataaaacaggttacattaatgtcgaacgatatcatgtaaacaacgttatatacaacaaacaaaaattcaattatggagaacaagaagctaacagctgccaacggtcgccccgttgcagacaatcagaattcacagacagtaggtccgcgcggacaaatggtattacaagatccttggtttttggagaaactggcccacttcgaccgcgaagtcattcccgaaagacgcatgcatgccaaaggttccggagcattcggaacctttaccgtgacacacgacatcactaaatacacaaaagctgtgatctttagtgaagtcggtaaaaagacagactgtttcgtccgtttctctaccgttgccggcgaacgcggagctgctgatgccgaacgcgatatccgtggttttgccatgaagttttatacagaagaaggtaactgggatttagtcggaaacaatacaccggtatttttcctgcgcgatccgttaaagttccccgatcttaaccatgccattaagagagatccgaaaacaaatatgcgtagtgccaataataattgggacttctggactttgctgccagaagcattacaccagatcaccatcacaatgagcccgcgtggcataccttattcttatcgtcacatgcatggtttcggtagccatacatatagctttatcaatgcaaagaacgaacgtatctgggtgaagttccacctgagaacattacagggaatcaagaacctgacagaccaggaggcggaagcaatcatcgccaaagaccgtgaatcgcatcagcgtgacttgtttgaaagcatcgaaaaaggagacttccctaaatggaaattccagatccagctgatgacggaagaacaggcagaaaactaccgtatcaatccgttcgacctgacaaaggtatggccgcacggcgacttcccgctgcatgacgtaggtattctcgaactgaaccgtaacccggaaaactatttcgcagatgtggaacaagctgccttcaacccgatcaatacgatagaaggtatcggtttctctcctgacaaaatgcttcagggccgtctgttctcttatggtgatgcacagcgttatcgcctgggtgtaaactctgaacaaatacctgtaaacaaaccccgttgtcctttccatgcttaccatcgcgacggagctatgcgcgtagacggcaactacggctcgacaaaaggatatgaaccgaacagctacggcgaatggcaggattcccccgaaaagaaagaaccgcctttgaaagccaacggcgatatctacaattacaacgaacgtgaatatgatgacgattattacagccagccaggcgacctgttccgcctgatgcctgccgacgaacaacagcttctgttcgaaaacactgcccgtcagatcggtggagccgaattgttcatccagcaacgtcacgtacgcaactgttacaaagccgatccggcctatggcaaaggtgttgccgatgcactgggtatcagcctggaagatgcattgaaggaaacaagatagtataagtacccacttgataaattctgttcaaaaaaagaatgcccacgataccggaaggtaaaggggcattctctatttttagtcgaacatatgtctgaatttgctgaatatcttctccttcatgctacgattcggttggaaattcggtgaattatccagccccgtcaatgtttctttttctgatgcggacaacgtttccggaatatatacgcttacattgaccaacaagtcacctgtcccgtaactgttcaccgaaggaagtcctttgttccgcagacgaagtaccttacccggttgtgtacccggttcgattttcaccttcgccttaccatcgatagtcggcacttcaacatttcctcccagtgcagcctgaggtacgctgagtaacagattatataataaatcgttctcatcccgaatcaattcaggatgcggctcttcttcgatcaggatcaacaggtcaccgtttatacctccatgacgggcagcatttcctttaccactcatcgacagttgcattccttccgcaacaccggccggaatattgattgtaatgatgtcgtcatcacgcatgataccttcaccgttacattcactacatttctttgtgatgatctttccttcacctccacaagtcggacaagtagactgcgtctgcatctgccccaggatcgtattggcaacacgtgttactacaccactaccatggcatgtatcacaggttttactgctatgatcatcctcggcaccactcccgtggcatttgctacaagaaacatatttcttaaccttaatcttcttttcaactccgttagcaatctctttcaggttcagttttaccttcacacgcaaatccgatccacggttcacccggcggcctccacgagaacctcctccaaaaccaccgaaaccgccaaagccaccaaaatgtccaccaaagatgtctccgaactgagagaagatatcttccattgacattccggctccaccaaagccacctccctgagaagcacctcctactccggcatgtccgaactggtcgtagcgttgacgtttctgaggatcgctcaatacatcatatgcttcggcagcttccttgaatttctcctctgcttccttgtcaccagggttcttgtcagggtggaactgaatcgcttttttccgatatgatttcttaatttcttctactgtggcagttctttctacctccagtacttcataataatctcttttagccatctttgtattgttgttatttgcccgttagcacgttgcttattctcctactactactttagcgtgacgcagcactctgtcatttaaagtataaccggtctggatacaatcgaggatttttcctttcaggccaggttccggagcaggaatagtagccacagcttcaaacatttcggtatcgaaaggttgtcctaccgcctctatggcttttacaccctgctgggccagataagccataaatttcgaatagataagttctactccttcctttacagcttcaacatcgtctgagttacggatattttgcaatgcacgttcaaaatcatcgacaacagggagcaatcctttcagggctgcttcagcaccattcttgatcagatcagccttttcacgcaatgtgcgtttacgataattgtcaaattcggccatcaagcgcaggtgagagtcgttcagttcgttatacttcttctccaacgcatccaactcttcggtcacattgtcagtctgtgcagtttcttctgccgcattttcctgttcgtgctgcaaatttgtcgcatcttcctgattcaaacactcatctttttcagatgtttctttctttccgttaaaattcatcttgctcataactatcttactgtttttattattacctaattgtcagccatatacaacgttatttatctaccaatacggactgtatagataaagttatccctgttgtcatgcactggaataacatcaaatatgctgccaactattcatagacaacaaaaatatctttacctttgcctgtatatttagatttaaacaggcattttaatactaataatagaatttcagacattatgaagagaattattttatccatattactgttgtttgtatttatgaccggctatgcccagaaccggaatgcatccatttgcagattaggatttacatatgatatcagccaaagtaaaaactgggggaaagataaacccgtaataacgggaataatcccctattcttctgcagagttagccggggtgaaacaaggtgatgtgatagaagcgatagacggagtagtcacaacggaagtatccccccaggagattgctgaactattcaatccggcaggtaaaaatgaagtgattctcacgatcagtaatctttccgttccaaccaaacaggtaatggtaaagaaagactgtaaaaagatcaactcaataatggaagaccagctggcatctgccttctcgatgtatagtctggaaacaaccggcgaacggacttttacatgccccttcaaaacggtagttacacccgactctgtcaatttcagtaaattcaaaacatttgcttttgctgcgatcgacgaaaacaaccgtaaactggaaactgcgatcaacgaatgcatcgagaaagaactgataaaaaaagggatggtacttgatatcgatcaaccggatatcctgatacagacattttatttctttgacaaaaacccgaatttcaaaggaacaaatgtgattatggtaaacaaagagcccatctaccgctataatttcactcaaagcaagatggaatctttcccgttcctgggtaattccgctgcggaagcagaagcagaatatctgttgcagttcggtttccgtatgatcgaccaggcatttgttcccggacgtatcatctgggaatgcgaggctaacgaattactggaagactcctatcgtctggaagaatacgcccgcatccatgcaccgttaatgctgatgcagtatccgtatgtaaaatatggccgcaacgtacaatataaggttagtcaaaaaacctataattatacgggtatcagttacgatatcgaccgcctggaactggttacggatgtcgaccgtaattcaccggcttatgcctccggccttcgcccgcgtgatgtgatcgaaaagatcaatggaaacaaaatgaattattccgctgaagaatttacagccggctataagaacttcatatcaaagacaatgaaataccgcgatccgaaaacacagtttacggatgctaacgggtttaaacgttgtatgttctgggatacattcaaatactctcaggttgccgacgccttgcaaagttccggcaatgtaggagccttctcctacctgtattattatgctccgtatgtcaatccggcaggaaacaatgcctgtacgttcgacatcaaaaggggtaagaacaaaatggaaatcatcgtccgccctactatccgcagggagattacggtggagataaaataaagcatattaactaacgtgatatatccacaaaactttgaacaaaaaacggggttcgataaagttcgccgtttaatttccgataaatgtttaagcccgctgggacaagagcgggtagccgaaatggatttttcggcagattattcaaccgttattgaacgtctggaacaaaccgatgagtttgtccgtattttacatggagaacaggaatttcctgctgcctatttctttgatgttcgttattcgctgaagcggatacgaccggaaggaacctggctggatgaaaaagaattgttcgacctgaaacgctctttacaaacaatcaacgatatcgttcgtttcttccgtcctgtagaggatgaggaaattgcttatcctgcacttacggcactggccggagacatactcgtttttccacaactgatcgggaaaatagactctatcctggataagttcgggaaagtaaaagacaatgcatctcctacactggcacagataagaaaagagataacatctacgatgagcggtatttcccgtagcctccaatcgatcttacgaagtgcgcagtcggaaggggtagtcgacaaagacgtaacccctaccatgcgtgacggacgtttgatgattcctgtagctccggctttcaaacgaaagataaaaggaattgtacatgacgaatcggccagtggtaagacggttttcatcgagccggaagtagttgttgaagccaacaaccgtgtaagggaactggaaggtgacgagcgccgtgaaatcatgaagatactgacggatttcaccaatatagtccgtccgatggttccggatatcctgcaatcgtatgagtttatggcagatatcgacttcatccgtgccaaagctatttttgccgaacaggtgaaaggaatcaaaccggtagtggaaaacgtacaacaggtagattgggcacgtgcggttcatcctctcctgtatctgtcgcttcagaaacagaacaagcaggttattccccttgacatcacactcgatgaaaagaaacgcatgttgatcatatccggcccgaatgccggaggtaaatcggtttgtctgaaaacagttggtttgctacaatatatgttgcaatgcgggttattaattcctttacatgaaagttcgcgcacggggatttttgccagcatatttattgatataggtgatgaacaaagtatcgagaatgatttgagtacatacagttcgcacctgaccaatatgaaatatttcgtcaggaactgtaatgaaaagacgatcatcctgatcgatgaattcggtagcggcacagaaccacagatcggaggtgctattgccgaagccctgttagaccggttcaaccggaaccatagtttcggagtgatcactacccactatcagaaccttaaacatttcgctgaagataccgaaggtattgtaaacggagccatgttatatgatcgtcatctgatgcaaccgttgttcaaactgtctatcggaaatccaggtagttcatttgccgtagagattgcacgaaagatcggattaccggaagatgtaattgcggatgcttcagccaaagtcggttccgattatatcgacatggataaatatcttcaggatatcgttcgcgacaaacgttactgggaaagcaaacggcaaaatatccgccaacaagagaaaaagctggaagatatcacgtcccgctacgaaaaggatctggaagaggtaaataagcaacgtaaagagatcatgcgtgaagcaaaagccgaagcacagcgaatactggccgaagcaaatgccaaaatcgaaaatacagttcgcgaaatcaaagaagctcaggcagaaaaagagcagaccaagcttgcccgtaaagctctggaagaattcaaagcgtctatcgaatcgaccggagaggaagacgataagattgcacgcaaaatagcgaaactacaggagcggaaagagcggaaaaagcaaaagcaaaatgctcctactgccaaacagacattcaaccgcgatgtgatcgaagtaggcgacaatgtccgtttaaaaggacaggtttctgcaggaacggttatggaacttcaagggaaacaagccgttgtggcattcggtatgataaagagtactgtgaaactcgaacaactggaaaaggtcagcaaaggccagatcaaaaaggaaattcaaaaaagtacctttgtcagtgtaggcacgacagaccatatgcacgagaaaaaactgaactttaagcaagagatagatgttagaggtatgaggggcgatgaagcactgcaaactgtcacctatttcattgacgatgccatccaggtcggagcagaacgggtacgtatcctgcacggcacgggtacgggtatcctgcgacaactgatacgcgactatctgcattcggttccgggagtccggcagtaccacgatgagcatgttcagtttggcggtgcaggtatcactgttgtagaactggattaaaacaattgtagttatgagacgaaaagagggaacgcatttgcgcaggcacagacatatttcaaaccgtcatctgtcggataaatattattatgccggtgaacatgaaactgtaaccgacattcgtctcacacaatacaatgctgaaggaatccacacggcagaagtcaagaaaggaacgacttcgttcaataaactgaccgatcccaacaaagttaactggtttcaggtaagcgggcttaccgattcggatgcaatcacgcgtatcgtaaacgatttcgggctccataacctggatgccaaagatatcctgactcctcaacatgtagtaaagatcgaagagtatgccaatcacatgctaattatcctaaactccagctattacgatgctaatatggaaatgcattccgagcatatcagtatactggtcacagataatgttgtcatctcttttactgagaccaacaatccgatatttgccagtacaatgaaagcacttgaatcgaatatgctgagtctgcggaagaaaggtagtggattgttactggctttccttttgaatacaattatcgctaatctggtagaaacggcatccaaagtagaagagatgttggaagatattgaagaaaccctgctcgacataaaaaacgatcaggggaatatgggctctttgatacagcagcgccgtcatgaatacatggtcatcagaaagaacagccagcctttgaaagaacagttccccaaactattacgtacggagaacggaataatcagcccggatatgctaccgatctataccgatttatccgaccagttgcagtttgtgatacaaacgaccgaaagttgcagggaaatcatatcgtcattagtagacctctatatatcaaacaacgacctgcgcatgaatgcaatcatgaaacgactgacggttgtgtctaccttgttcattccactgacattccttgtcggcgtatggggtatgaattttaaactgatgcctgaactcgactggaaatacggttatggaatagcctggagtgtcatgtttcttaccggtttgctcacctggatatatatgaggaaaaaggactggttttaaagtccgtaattcctcttaaactgatagtaagtgtttctggaaacattgaaatgcttacagatcatcacgaccgtatcgcctctctcgagcatattcatcacttcttctttattggcatccaacaaagactgtttggcatcggtacctttcggacgtcctaactgcagtcctttatccttcttatgattcaatgcttctttcgtccggatcgacatcaggttatgttcgatctcagaaatcagattgcacgtatccgatactaccgtcgtattcaaaccgtcatccagaatataacgatcgtttatactgcatacatgaatacctttcgccatacatttgcctaaaagagtcatcacttcggataaggtacggccaaacctggcaatatcagtaatgatcaccttatccccttgtttcatccggtctatgatacgacttaatgacgactctttctcctttcttttttcatcaataatatccgttatccatttattgacctcaaaaccatttgctgctgcatagcgttcaatttcatctttttgtgtttcaagatgctgcttgcctatagttactcttaaataagctattaccataaaaattttacctcttaatatattgaatatgcaaaatatattttttgtttacgccgtgaagatacaacaagaaaatgtgactgacagcaagatgaaacattctttaataagctctccatacattttatattttaatccggagaaactgttatatctttgcaattatgaaaaaatatatcttagtcatattaacaattctatatatcggagtctccagtggaatagctctgaatatccatcattgtatgggtaaactggtagaagtggatttatggctgacggatatatgcccttcctgcaaggagaagcagcaatcacatcattgctgctcgacagagacacagttgatcaagatgactgtcgaccagaatgtcaaccagatgccgactttcgattatacgccggtcactctatctttattattcaatataagggaacttttggttttgtctgagacagatgaatcaatttcgtccttttccttttttaaatccccacccgaatgtagtggcgcagagctatgcattcgcaattgttcctttctgatttaattaataccggttttacagaccggacatacctatttttgtttatacttcaataaacaataaataagaattatctgttccttttgtataacgcaagaggaaagcttacatgcatcggtattctttggaaaacaaagcctacccattgcaacaagattttatgcattaattaaatcattttgattaaaacatcattctatgctaaataaaataatccgttatttccttgataacagggttgtaaccattctattattaatattagtcattgtctggggtatatcgacctctcccttcaactggcacggaggtattattccgcgtaatccgatcccggtagacgcaatcccggatatcggtgacaaccaacagatcgtcgcaaccgaatggatggggcgatcgccaaaagatatacaagatcagatcacttatccactgaccacttccctattggggattccgggagtaaaaagtatccggagtagctccatgttcgggatgtcgttcatctacatcatcttcgacgatgatatagagttctactggagtcgttcaaggattctggaaaaactgaattcactgccatccggcaccttgccggaaggcgttcaaccggcattaggtccggatgccacagctctgggtcaaatatactggtacaccctggaaggcagaaacccggagacagggaaacctaccggcggttggaatgccgaagaattgcgtaccatacaggatttctatgtaaaatactccctttccgcggccgaaggagtatcggaagtggcttctgccggaggttttgtaaaagaatatcagatagaactgaacccggatgccatgcgcgccttcaacgtttccgtcatggatatcatgaatgccgtaaagaaaagtaatctcgacatcggtgccgaaacgatggagatcaacaaggtagaatacctgatccgtgggcttggctatattaaagatgtatctgacctggaaaaagctgtcgtaaccgtcagggacggtgtaccggtacgcatatcggatgtagctttcgtgaatatcggtccgggtacccggcgtggcggattggataaggaaggcgtagaagccgtggggggagttgttatcgcccggtacggagcgaatccgttggaagtgatcgacaatgttaaagctaagattaaagaaatagaagccggtcttcctcaaaaaacactggcggacggcactgtgtcgaaggttaatgtcatacctttttacgaccggaccggcctaatcaaagaaacgatcggaacacttgaaacttcgctctcacacgaaatactgatctgtatcatcgtaatcattgtattggtccttaacctgcgcgcatccgtagtaatagcaagtatgctcccagtggccgtactggctacatttatcatcatgaaatacaccgggatagaagcaaacattgttgctttgtccggtattgccattgctatcggagtcatggtcgatgtaggggtcgtatttgtagaaagcattattcgttatatggaaatgccggagaacaagagtatcaaaggcgggaaagcattgatcaaccttatctacaaggctgtcagtgaagtatccggagccatagcaacggctatgatcaccacaatagtcagttttttacctgtatttgccatggaggctcaggaagggaaaatgttctctcccctcgcctatactaaaacgtatgcactggcatccgctttcatactagggttgatcctcctgccgacactttcttatttgctgttctctgtccggatcaattccagatcgatacgaaagatagccaattacctcctgattgtagcaggcattgctttgtcaatcatttacagtagtattccggtacttggccttacggctgtcggactaaacaatcttcttgtctcctactggaaaaatccgaagactagcaactatatcaatataggtatcaccttactagtggcagtttattatctgtcggaagaatggctaccgatgggacctcaggccggattattctccaacatacttttcgtagcggcttgtatcgttgtcatcttaaccctcctatggttgctggtgatctactacgaacagatattaagatggtgcctcagtcaccgttggcagttcatgatcattcctacgacaacaatcctgttcggtatcattatatggataggatttaataaaacattcggattcgttgcatcaggtatggaaacgctgggatggaaagatttccgccagacaactttctgggaaaaagcatccgctgagtttcccggtataggcgaagagtttatgcccagcctgaatgaaggttccttcctcctgatgcccaccagcatgcctcataccggaattgcacaaaacctcgattatatcgaagcgctcgacaaacgcctggcagccattccggaagtggagacagccatcggaaaatggggacgcgtcaactcagccctcgaccctgctccggcacaaatgtttgaaaatacgataaactatcgtcctgaatacattctgaatgaagacgggcaaaggggacgtttcaaggttaataaacagggtgcctacatgctgaaaaacggcgatacatacaatccggctgacggtttccggctcattcccaaagacagtctgatagccgacagtaaaggagactatttccgccaatggcgtccggaaataaaaaacacagacgatatctggcaacagatagtaaatgtcacccatctgccgggtcttacttcagctcccaagttgcagccaatcgaggcccgtctcgttatgttgtcgaccggtatgcgtgccccgatgggattgaaaatatacggtcccgacctggaaacgatcgaacagagcggtaaggttatcgagcaggcattaaaagaagtgccttccgtaatcccttcctccgtattctatgacagggcggtaggagctccttatctcgaaatcaatttaaacagggacaacatggcgcgttatggagtgaatgtagaagatttgcaggaaatattaagtgctgctgtcggtggaatggtattgacgacaacggtcgaaggaagggagcgttttccggtccgcctacgttatgcccgcgaattgcgggataatccggaagcattgtctatgttactggttcctacggcaacgggagcccagataccattgaaagaactggccgatatcgattatacccgtggagcccaaatgatacaaagtgaaaacacgttcctggtcggctatgtcattttcgacaaaatatccggtaaagcagaggtcgatgtggttaaagaagccacccgcttacttgaacaaaaaataaaggatggtgaactgactctggccaaaggggtatcttacaagtttgcagggaactatgagcaacaggaacgggctacccagcggctggcaattgtagtgcctctggcattactgattgttctgttggtcttatatttccagttcaagacggttacagcctctcttatccacttctcaggtgtatttgttgcctttgccggaggatttatcctgctttggctgtatggacaggattggtttatgaacttctccgtcggcggagagaatatgagggatcttttccagatgcataccatcaacctgagtgttgccgtctgggtcgggtttattgctttgttcggtgttgcaaccgacgacggagtattgatgggtacttacatccaccaaacattcctccggcaaaatccccgtacgaaagaggctatacgggaagccgttgttactgccggattaaaacgtgtacgaccggccgccatgacaacggcaacaacactgattgccttacttccggtattgacctcgacagggaaaggtgccgatatcatggtaccgatggcaatacccaccttcgggggaatgctgatacagtctatgaccatgtttgtcgtacccgtcctgcaatgctggtggcgtgagagcgtaattaagaaagaacaaaagaaacaaaacattgaaaatgacacaagcgatgaagaataatctcaaaatacaactatatctgatcggtatcgccttactgctcggtactttatccggatattcacagcaggcagatagccttgcttactatctggaaacagccgctcgcaataatccgctggtcaactccaacttcgccctttataaagcttcactggaaaaaattccacaagcgggagcctactccgatccggaattggatataggcctttttgtcaaacccatggaaacactgggaggaaaacagattgcagacttcacactcatgcagatgtttccctggttcggaacacaaaaagcagcacgtaacgaagcgacagaaatgtcacgtatggcctacgagcaattccgtgatgccagaaacaacctgttctatgaggtcaaaagccagtggtatcaactatgtaatctgaatgaacagtataaaaatacacaggcaaatcttattttgctggagcaattggaacagttggcacttaagcgtttctccgcacccggtgtcccctccacaccgacagtaactccacctgtagccaataccccccaggctctacctgcctcatccggaaacagtatgggcaatatgggaggaacaggtaatacttcgccaacaacagccatgccagcatccaataatagcggaatgtccggcatgggaggaagccccatggggacaggaaattcttccggaggtatgtcagatgtattgcgtatccagatagaaaaagcagaacttgagaataatctggaagtaattatctccaaccgtaccgcagctgaagcccggttcaatgccttattaaaccgcgatcaacagacaagagtggctatacccgactcactgatacaaattcgtttcctggcagatgacaaaacgataaccgacagcattatcctggccaacccgatgttatcgatgctggaagcagaggcgaatgcctataaggccaaagcaataatggataagaagatgagttatccgatgttcggtatcggcctgcaatattcggtagtcggtaaatcagataatgtaatggtcatgcctgacatgaacggaatggatatggtcatgcccatgttcaagataagtatccccattttccgaaagaaatataacgcacaacaacgggaaagtaaacattaccgccaggcaagtgagctaaaatacgaaaatacgctgaaccagttgcaggccgagtatcagacagtcaaacaacaactggcagatgcagcccgtaaagtcagcttatataaaaaacagcaaaacctggctttatccacctggcaactgatggtacgagaattctcagccggagtgaccagcctcaccgacattatacaagtcgaacgccagttactggattacagtctcaaaaaaagtgaagcagttgccgaatacaacacaatggtagccggcatggaaaagttagtagcaacctcattaaatgattaatcgtatgaaaaagataaaagaatggatcaagacaaagcaagttcaatatataatattcgcacttgcaggattattagtcggctggttattattcagcccctcctccaccccgcagactgacagcagccatcacgatcattcccatgacagcatagccgggcattcccatagccacgatctgcaacaggatgaaaacggggtctggacctgttccatgcatcctcagatccgacaggataaaccgggtaaatgtcctatctgcggcatggacctgatacctgtacgcaaaagcggtaacaataacgaaaacatcgatccttcgtctattcagttatcgaaagaagctatggcgctggccgatgtacaaacatcgcgtgtcagtaaagaaaatccggtaaaacaagtacgtctctatggcaaaatagcaccggacgaacggagtcttcaatcgcagacagctcatgtaggaggccgcatcgaaaaccttgccgtcgattttacaggagaaaccgtacgtagcggccagacacttgccaccttatactcgccggaactatttacagcccagcaggaattactggaagctataaaaatgcaacaaccggcattgatccaggcggccaaagaaaaactgcaactctggaaaatgaccgatgcacaaattacagccatcgagcaatcgggtactacttccccgttagtagaaatcaaatcaaacaccagcggtatcgtcatatcgaaaaaggtcagccagggagattatgtatcacaaggagctatcctattcgatgtagccaacctttccaaggtatgggctatgttcgatgcttacgaagtcgacctgccttttttaagtaaaggcgacccggtggaattcaccttgcaggctcttcccggcaaagtatacaaaggcaagatcgcatttatcgaccccattgtaaacgttgccagccgtacttcccgggtacgtgtcgaggtatccaacccccagatggaactaaaaccggaaatgtatgcgacagctactgtcaatgcagctttaaaaggatacaaagaccagatcgtcgttccacagacagccgtactttggaccggaaaacgtgcaatagtatatgtcaaacagccggacatctccacacccactttccggatgcgggaagtagaattgggtccgtcgttaggcaatgcttatgtcatactgaaaggattatccgatggagaagaaattgtgacaaacggggtcttttcaatcgatgccagtgcccagctggaaggaaaaccttctatgatgaacaatgacggaaacgccacacaaccgatgaccgggcacgccggacattctatgcaagcctccaatgtacaaagcgaacatgccatgttcggagtaaaaggtgcctgcgatatgtgtaaacaacgtatcgaagatacagccaagagtattaaaggagtctcgtccgccatgtgggacaaagatgcccagatggtacatttacagtttgaccctaaacaaacatctgtcgatgccatagccaaagccattgttgcagccgggcacgacaatgacaagtacaaggcagaccaaaatgtttacgacaagcttccggcctgctgtcattaccggaaataggaacacagacaggcgcaacaaaaaaagggctacaacttatttgtatccctttattcgttgcgcctaaaatatcagttccctgtttaataatacgtttctgtcagtggaatatttatttcaacaaacagcatatcgccaccctcgttccggaaacgtattttgttttcccgggctaaccaacctaaagcaagaaaaattacagactccctgcaatgagtcatttctccaatctttctgatggacatgttgcccctttctgcaagcaaacgccagatcttaccggcatctgaaccaacgtcattcttattcataacactccatttttgatatgtgacctaaaactaacaattaaaaataaaacagaggtgttccattttacttccttattagtcaattataccattattcatcaattattccctctttgataacaaaatgactttgttttactattataaaacagatcacaaacaataaaagtttcaccaaacagcatatattcatattaattcgtaagaataaacgaattataacttacaatcagaaacaggctcctaacatcatctcgttatcagggacttggccaaagaaaatcgaaaatatcccaaacaaagcttctccataaaatgtttgaaatataactaaagaggtcttcgtgtgacctccaggtcatatgaagaacctgttgtactaatgcattgttgggatacttatgggggtttgtcttatttatgactgatagctgatggacagacaggggcattttcctatattattgactcagttatttctatattcgatcgcgaagcccaactgtcacttgtcaactgtcaactgaaaaaggtttatccttttttctcctgctgcctgaactgcgaaggggtaatacctttgatctgtttgaacaaggtactgaaatgacggggatattcaaagccgacggtttcggatatctctgttatattcatggtggagcctatcagcagctgagaagccttctcgatacggatcatattgatgtaatcgtttacccccatattggttagtgccttcaacttggcgtaaagcggcgtacggctcattcccagctgggtagtcaggaacttgacgtcgagttcgcgggacgatagattatcatagatcagcttgtttaacttcagcatgaattcttcatccaggttgtttgtcggggcggtggggatcgcttctgtcagatgcagatggctttccttgtatttctgtttgacagcttcccggttcttcaactggttgctgatgaccgtcattaatagttccatatcgaaaggtttagccagataagcatctgctccgagcttgtaacccattgtagtactatcgagatcgcccctggctgtaagaaggatcaccggaatatggcttgtcgcgatatcttctttgatcttcttgcataattcatatccgttcatctttggcatcatgatgtcgctgacgatgatgtcggggtgcttctgccggatgatctgcacggcttcctccccgttagccgccagatatacattcttaaaggactcctgtaatgcttctttcaggaaagaactcaattctttcttgtcttcgacgataatcacagaatagttattggtggagaaagcttccggttcggacggcgtctcgacaggctgccaagtgtcgtatcggctttcttcattttccgggttatcgctctcggtatcgagtggcagttcgaagaagaaagtggccccaccatcggtattgttcattgccccgatcgttcctccatgccgttcgatcaggactttggcgaacgatagtccgataccacttcccgattgctcatggttcccctgatagtaacgggtaaagagtttatctatatccaggttacccagaccgatcccctggtcggcaacgctgacatatactttgctatccatcagctgactggatacagtaatggtcgtatccggcgaactgaacttcagagcattcattaatagattcgagaggaccgtcgtacatttctgtccatcgaaactaacctgtccgatcctgtcgtccaaccggtaatctatgcggatatgccgggcttcgagctcactttcaaaatccttcgcaatcgaactgatccattcattgagcggatgaggtgttttatgcagggaactcttcgtttctttcaggctgttcatatccagtaccatattgataatgttacgcatatcgagtacctgtttatagataccacccagttgtcctttcagtttctccggatcgttccagctgtttttgtcgagtatccttttcaacggggcatagatcagcgtcagtggagtacgcaactcatggctgatattgattaggaaatgtactttctcttcattaatcttattggtatgttcctttatcttccattgcattttcctgtctctgcgtcggcgggatacataatctatccatagcaatatcagaataaacagaataataaagatcgcgaagacataagggcgctgataccagggcggtgtcaccgtgatatgaagcacatcggccggttcgctccattcgccgctctttgaattacaggacaccaggatcgaataactactgggagccagcatgcgaagggagaggatgtgactgtatgtttcggtatactgcttgtcgagtccggtgatcgtgtagcggtacaacttgtttctgaatacatctttctccattgcgatcacttttatttccaccgagctatgggtatggggaatggtgatattattattccccggttgtagcttgtcgatgcaagagtttccgtcgagtaatacgtccatcagcctgatttcgggcaggtcttcttccttggtagatatatttttattgatacgcaataagccggaagctcctcccagataaatataatccgagatggaagatacctggtacttataaatgaactcgttagtggtatatccatccgactctccccatgaggcaaagcgtttctttttcaggtcgtaagagaataacatattgcgtgcaccgatccaaagccgctcctgttcgtcaagaagaagggtggatacgctgttgaatagcttggtctctattttggtaaactcttttgtgttcgaattgaagtaaccgaaaccatactctgttccgatccagaagatgccgttcttatcgcgggcaacggctttgatcgtttcgtgttccccgatactgagcaggacatgtattgtgtcgttgccatgatgtacttcataaagcttattactctgaatgatataagcggaccggtcgtcggtgcataccatcttcatcggaccgacggctaattcttttccatcgactttcaggaatgagaatttcccggtcttaagattatggctgagagcatttttgcccaggaagtaagaccactcatccgtgatcctgtaagccatagacgcattaccaccgtgaaactggtcgattgtcgtcgcttcatcgatcacatagaaagggcggctgtaacgtcctatctccttattgaacaggtaaagacctttcgtatatagggatacaagcagttccgagtctgaataatcggtaatagatacgaccttgtccccgtatgtggaagggtaatgcttgaatgtatcggtatagggattgtattggttgatccctcctccgtccgtccccagccataagcgtcctcgtttatcttcatggatgctgatgactgatatgtcgcttaatccgtttgtattgttgagaggtacatccttatatgttttcataaagacctcctttataccgatcatgccgcctctaactgttccgccccagatattatcctgtttatccttgtaaagacatttgacggaattaacaggaagggaactcatgtctcccggtgtatgcataatggcagtgatatccgaagggttatccagatccatgatattgatacctccgccatcagtggttatccagagtttattatctatctccataaagtcgagaaccaggttgttattcagttttgaatttcctgtatggatatgatagagtttctcaccgttaggggcatagcaaacgaatcctttattataggaagacagataaagtctttttttactatccagataggcggcgttcagattagtctgcaccggataatctgtgggggagatctgaccggaaaccggattatatctgagaatgccgttccagtgggagataagcaaaagctctccattctcccagggttttatgtaatacggcctgaagttggatgagtccttttggatgatcgatcttttactgaatgcctgctttttataatcatatatgtacaggccatcgtttgctgagaagaggatggcgccggggcaggtataaaaagagtttgtcaggatcgctttatcttcgaacaggatcggatggaatgagtcgctgctcttgtcgtacagggtcaagccgttattggtcgatatccagatattgttcagggagtcttctgccaggaagtagatcgtatttcccggtaaagaaaagggattatctttttcatggaaatagcttttcatatcgtaacggtcgaaacagttcagtcccgaagcagtcccgatccagatcagtcctttgttgtcggccaggatacaattaactgttgtttgcgagagtcctttgtcaagactcagttgctggaaataataactgggattgttcccctttataaatccgttgcaggaaaacagcaggatcaaaaaatataaaattcgtgtaacagagcttcttaccatcatatctcattctaattaccgcaaatttaataaaaccaatctgaagttgaaaatagctgacttaattagaacttcgggatgaattttgacatgaaaagtacgcaggttgacatccgtttgtggcggaaaatgcaactttgcgttgtgaatagttaactaattataaacgcttatggtatagttaagagttgattttttacatgaggtagtgaaccactgggtagttacccgtcttgagaactttattttattatcatttaaaattcgattttatgaaaaaatctcttgtaacattgttactgatgttattctgttgtgctgtttttgcacagcaaaatgtgaatggcgttgtcatagaagaggctacgttggaacccttggccggagcagccgttcaggtgaaaaactcacagagcggaacgattgccgatgcggatggaaagttttccattagcgtatcgcccggacaaactttattgatttcttatattggcatgatccctcaggagatactcgtgaaggaaggcatgactaatctaactattaaaatgcttagtgacgcagtggatataaacgaagtagtagtggtaggctatggtgtacagaagaaagtgaatctgaccggttcggtttcttcggtgaaaggcgaggcgctggagcttcgtccggtagctgatgccgtgcagagtctgcaggggatggtgccggggttgctggttagcaactccagtggcggtcgtcccggaggtaccggtactttgacattgcgtggacaaggaaaccttgacaataacgctgcaccttatatcctggtggacggtgtggaaatgagcctttcggatgtaaatcccagcgatattgaaaacatatcggtattgaaggatgcggcggcctgtgctatctacggtgcgcgtgctgcttatggtgtgatcctggtgactaccaagaaaggggaagaaggtaaaatgcgtatcaattaccagggaacggtaggttggagttcgccgactgtattgccggatatggttaattcgtacgactttgctcaatactggaatgcgggtgttacgaatgccggctcaccgcgtttgtacagtgacgaaaagctggctttgctgcaacagtatattaatgatccgagcagcgtaaatccgtggttcgaactgcctgccaatgccaatatgaacccggctttcgaaaactcggagtctggagtaggtaatgtgaactattttgatttgcattataagaactgggcttttaagcagaaccataacatcagcctgagcggtggcggtaaagcggcacaatattatatctcaggaggatattattcagaagacggtatccttcgttatgccgacatggattataaacgttataattttgcggcaaatatcacttcacagctgaccagctggatgaagttgaaagtgaattccaaattcatgcactctgatcagaataccccattcggtgacggtggtatcagcgaaggtttctatcattcgctggcacgtttccgcccgacggtttcgccgatcgacccgaacggaaactttacggagttaacaatgatcccgtacctgcagagcggtacttatacgaatacacagcgtgataatatgaaccttaccgccggtttggaaatccagccgatgaagaactggttcatctttttcgactatacgtataaaatgggtaacaaggaatatgaagccttgaacgtcagcccgcttatttatggagccgacggtgtaagtacttccaaaggggtacgctcggagttgggcatgtcgcctgatggtaaatttacccgtagctatgaccgctcacgttatcagtcgatcaatttgtatacaaattaccttttcagtattgctgaaaagcataactttacagtaatggctggttttcaggaagaagattataactacagcctgatgaagaactccattacaggattatattcaaccagcaatccgaacgtgggaatgggtacaggagacaagaccgttgtcgatacccgtaacggctgggctacccgcggcttcttcggacgtatcaattatgattacgatggtcgttatctggttgaagtgaacgggcgttacgacggttcttcccgtttcgcttccggcaaccgctgggggttcttcccttccgtatcactgggatggaatatcacccgtgaagagtttatgagctctgtgacagacgtactctcaaaccttaagctccgtggttcttatggattgttgggtaaccaggcaggtgctgccctgtatacttttgctgcaacgatggagttgaacaacggtttaggtaactatatcttctccgacggacgtcatatctttacaaaagcgccgggtgtagtaaatccgaatacgacctgggaaaaagtggaaagtaagaatatcggtatcgatttcggtttcctaggaaactctttgaccggtacgttcgacatcttccagcgcgatacgaaagatatgttaggccctggtgtcgatttccctgattttttcggagccgatgcacctaaaacaaataatgcacgtatgcgtaaccggggatgggagttggctttgaattatcgcggacaaatcaacggtgatattcaatatacgatcggtggttcaatctccgatgccacttcagaagtaactgagtatgccaacccgaccggaacgaacccgaatgacaattggtatacaggtaagaaagtgggtgaaatctggggctatcgtgccgatggtctgatacagacacaggaagaagcggatgcttataatgaaaaatatgatatgtcgtttatcagcggacgtccctggacaccgggcgatgtgaagtaccgcgacctgaatggcgacaataaagttaataacggaaccaatacattggatgatatgggtgatatgacggtgatcggtaatacgaccccgcgttatcaatatacagtgaacggttccatcagttggaagggcataagcctgagcatgatgttccaaggtgtaggcaaacgtgactggaatccgggaacaggtgcttatttctggggaagcggtccgtatgcacaggtgactgtgttcaaggaacatctggattactggagtgaatcgaatccgggtgcttactatccgaaaccctatatccatacggcaggtggcgttgtcccgttccgtgataaaacgatgacgaccagcgaccggtatattcagagcggtgcgtattgccgtttgaaaaacctgacagtaagctatgaccttcctacaatctggacaaacaaagtcggtttgcagaaggcacaggtattcttctccggtgagaacttattgacttttacaaagttaaaaggtatgtatgacccggaagcgatctatacaaagaatgattataccagtgaaggtggtaagaactatccgatgaaccgggtgatatctgtgggtttagtagttaacttataatttagagatcttatgaaaaaaagaaatatatttttaggcttgatcctggctttctgccttacatcttgctttgatttagataaaatgccggaaggtgtgctttctactgcacagcctttcaacagtaccggcgaaatgagaaactacctggaccagttctatcagacaggtgcagcttatggtagcggcctgcgtgcacaggatttcggtgccggtggaggtggtaatattgccgggtatgatacacacagtgataatatgtcgtccagctcggtgagttctcgtctggctggagagaccacattgagtggagcttccaaactgtcgaactatacaggtatccgcaatctgaattttttacttaataacttaggtaactgcgcagaagagggaagttcggattataaccagtatgtaggtgaagcctactatttccgtgcctggtattattatcagatgtttgtgaattatggtcccctgacatgggtcagtacgccgctcgatccggacgaaggtgccatgcaacttccccgcgacagtcgtacggtcgtagccgacagtatcctggcggatctggataaggcgatcttttatttgaacgaacagaataatagtggctctatgcgtgtgcacagagacgttgcccgtgccctgaagagcgaagtcgccctgtttgaaggaacctgggagaaatatcacaaggcaaaaggtgataagttttatgatccttcggtgacagacgaaaagataaaaagttatttcacacaggctattgctgctgccaaagaggtgatggaccgtggtgtatggaagatttatacaaccggaaatacaacgaacgattaccgtcagatgttccagacaacagatttatccggaaactcagaagtcctctggtttaagatgtatgacggcgaccagatcggaaacaacgtgaaccgttacctgaaccagggtggcggaggtgtcggcgtgacagcttcattggtagacgattacctgactatcgacggaaagccttttgtaggcaatgcactgatagaagccaagaaggtattcggaaatgaactattgccaacagttcgcgacccgcgtctggtacaaaccatttgtgcaccgggacagcaactccgtccggacgatgcacctccttattacgtggttccgccgctgataggttcctctgcctataaccagaacatgaccggttattctttattgaagcatgtacagatcgattataccggtagtctggatgcagaattcaagggagcaacgcctgctattcagttccgttatgccgatatcctgttaaattacgcagaagcaatggctgaattggatggagctgctaattctcaaaatattatcgtagctttgcaaccgttgcgtgatcgtgtcggtatgcctgccgttgactttgatcgggagtataatcaggaatccgattatcctttccgtcatctggataagtatattcaggtcgtacgccgtgaacgccgtattgaaaaagcttgtgaaggccgtcgtctggaagatatcctgcgttgggctgctgccgatgaactgattgtcggtaagtgggcgaaaggtgctctttttgtaggaagcaacttgcaggatcatccggagtttggcggtaagctggtgtatgaccagccttccggaaataatctttatctgacaggaaagccgggagatgccttgcgctatatagtgcccagcaatccggccggttacgaacaaggatggaagtttaatgtcggtcgcgactatctgtcgcctattcaacctcgtatgctgtcgctgacaggaggtaaatgggagcagaacccagggtggtaaactcatttatataagcaagatatatgaaaaacgttagatctacagtattattttctttaacaggagcagcgatgttggcatcgctgccctcctgcaaggagaaaaaagtggcagaggaggcaaagaagccgatgaatatcctctacatcatgtgtgatgaccattcgtaccagacaatcagtgcgtacgataaccggttcattgagacacctaatattgaccgtatcgccaaagaaggagtccgttttacaaacagttttgtcgccaactcgttaagcggcccgagccgtgcttgtttgctgaccggtaagcatagccataaaaatggctttaccgacaacacacatacttttgacggtgcacagcagacgttccctaaactgttgaggcaggctggctaccagactgctatcgtaggtaaatggcaccttacttccgatccgaccggatttgactactggaatatcctgaccggacagggagactattacaatccgtattttatcgacaacggtgagaagaaacaaattgaaggatacgccaccaatataacgaccgatctggcaatcgactggctggatcaaaagagggataaggagaaaccgttctgcctgctcctgcatcacaaggctccgcaccgtacttggatgcccgatacttgcgatctggagttgtacaaggacgttgttttccctattccggaaacattctatgacaagtatgaaggcagaatcgctgcttctcaacaggaaatgagcatcatcaaggatatggatctcgtctatgacttgaagctggccgataaagagaacgagatccattccaatccgggactggaaaaggccggccgtgcaatgtacaacaagctcaatgctgaacaaaaggctgcctgggataaacattacgatcctatcatcaaggagttcaaggaaaagaaactttccggtaaagcgttggcagagtggaaataccagcaatatatgctcgattatatccgtgtgatccattctgtagaccgcaatgtgggtcgtgtactggattatctggaaaagaacgacatgctggataatacgatcattgtttatacttcagatcagggcttctatatgggtgaacatggctggttcgacaaacgtttcatgtatgaagaatctttccgtacaccgatgctggttcgctatccgggtggtataaagggtgatatccctgaaatggttcagaatatcgaccatgctgcgacattcctggaactggccggtgcaccgataccggaagatatccagggagattcttatttgccgctgttgaaaggagaacatccgaaggactggcgtacttctttgtattaccattattacgaattccctgccgaacatatggtaaaacgtcattatggagtacgtacggatcgttataaattaatgcatttctacgacgatatcgatgtatgggaattgtatgatctgcaaaacgacccgatggagatgaataacctctataataaaccgggtacggaagaagtgaccaagcagttaatggacgaacttcacaagctgcagaaacagtacgacgacccgatcgaatcggaactggcaaagaagagctgattttataactgtaaaatagatgtgagaggatgtccttagtcgggcatcctctttttactttcttatctattactaggattaaatacaaaaaaaggttcactttatcagtgaacctttgcgtgtgtgcttttccgtggagcatatcggactcgaaccgatcaccttcagactgccagtctgacgctctagccagatgagctaatgccccgggtttggttttcgagtgcaaatatagaggttttcctgatatattcgctatctttgtgtaagaaatttggagaaaaagaatatgattatttataatacaacattcaatatagagaatgatatccttaccgagtgcatagaatatctgaaaaagagttatataccccgtgcagcagccagcggatttttaagaacaccttacttacgccgtatcttacaggatgagtcggaagatgcgagcagttactctgtgcagttccatgtaaagaatccggagacactggaatactggatgcaatcggaaggccgtgccctgcagcaagagttgattacacgtttcggaaccaagatcgtaggtttcagtaccttactggaagaaatagactgggagaatgactaaggaccgtatcatattgggtatagaccccggaacgatcgtgatgggatacggtgtcctgaagatcgaagggaataaaccgaaacttgaggctatgggcgtactgcagctgaacaagtacgaagatcattacctgcgcttaaagaagatatttgaacgtgtactggcgcttatcgaccagtatcatcctgacgaattggcaatcgaggcgccgttctttggaaagaatgtgcagagtatgctgaagctgggaagagcccagggcgttgccatggcggcagctttggaacgggaaatcccgatcttcgaatacgcacctttgaagatcaaaatgtctattaccggtaacgggaatgctgcgaaggaacaggtggcaggaatgctacaacgtttcctgcatattcccgaagagtcgatgttgccccaattggatgcgaccgacggattggcagccgctgtatgtcattattttcagacgaataatccgatttcggagaagaagtattccggctggaaagactttatggcaaagaatcccggtaaggtgaggaaataaaaaaactccggtccctgttaaaccaaggatcggagtttcttaattatggaaagaaattatcttttgccaagcttgtgatccagaagaattgcatgatgttctccatacattttcagttggtctacaatagcctttgccgatgattcttcttctacctgttcgcgaacgaaaccatataaaaagtctttggcagcatgatcgttgtcggcttcggcgatgtcaaccatcttgtcgatcaactctgatacatgtacttcgtgtttgtagacatgttcgaatacttccagcggagtaccccatgcagtcggaacgacattaatctgatttatagtgatgtcacccccgcggtcgatagcaaaatcgatcattttgtgggcatgttccatttcttcttctgcctgttttctcatccagtgtgcacagccgttcaggcctgctttctggaaatagattgacattgacaggtacaggtttgaagaccacatttcagcttctacctgttcattgaaagcttttgataagttcttacttaagatcataatgtttacttttattgagttgtatttgtataaaagtaattacaaaaagtgtgccatactttattatacaataccttgtgccatcatagctttggctactttcatgaagccggcaatgttggcacctttcacatagttcacataattgccctccttaccgtgagcaaggcattgctcgtggatggcacccatgatctgatgcagtctggcatccacttcttcagcagtccaggagatatgcatggcattctgcgtcatttcaagtcccgaagttgctacaccacccgcgttaacggctttacccggagcaaacaactgtttgtgttcgatgaacagatcgacagcttccgccgtacatcccatgttggagacttcggcaacgcataaggtcttgttctcgatcagcttgcgggcatcgtcggcatccagctcgttctgagtagcacaaggcagggcaatatccactttctgttcccaaggcttcttgccaggatagaaagtagcgttaggatattcgtcggcataaggtgccacgatatcgttgccgctgttacgcaattccagcatgtactcgatcttatcgcccgagataccgtccggatcatacacatatccgtccggaccggagatcgttacgactttagcacccagttcggtagctttctttgtcgctccccaagccacatttccgaaaccggaaacggcgactgtttttccttttatatcgattccatgtgtttcgagcatctggtgtacaaaataaagtgcaccgtagccggttgcttccggacgaaggatagaacctccgaactccatgcctttaccggtgaaagtccccgtgttttcacgagccagtttcttatacattccatacatataacctacttcgcgtccacctacgccgatatcacctgccggaacatcccggtccggacccaggttacgccataattccagtatgaaagcctggcagaaacgcatgatttccgcatcactctttccacggggtgcaaagtctgaaccgcctttaccgccacccattggcaatgttgtcagtgcatttttgaatgtttgttcaaatccgaggaacttaaggatagaaaggtttacagacggatggaaacggattcctcctttatacgggccgatcgcattattaaattgtacgcggtatcctaaattgacttgtacttcacctttgtcgtctacccagggtacacggaaagtaaagatacgttccggttctaccagccgttcgatgatcttggctttctcgaactccggatgttggttataaacctcttctattgataaaagaacttctttcacggcttgcaagtactctttttcacccgggtgctttgcttccagtgcagataaaataacttctgtcttcatagcgtttcttgcttttttaggaataacaatgtgtaggcaaatgtagcgaatcctatggattgaccaagtattttgctttctttttgatagtaaattatatgtttttgatgcatatctttggactgattcttcttacttgccgtccttctatcttcaatatacctaatatttagtgtacagataagcgtcttttaatattcaggtcatgacttcttttttcttttttttccttacatttgggcgcatataattctatgaaatcgttatgagcggaataccggattttaagaaccttgtgtttaaagacacatcattcgccaatctaatgaataagcgtatatataatgtattgcttattgctacaaaatatgatgcctttatgttggaagacgacgggcgggtcgatgaacagatatttaacgaatatacttcgctgagccttcgttatcctccccgttttacccaggtgactacggaagaagaagcactggctgaactggaagaccgtaattttgaattgatcatctgtatgcctaatatggacgaccgtgatatttttgcggcggcaaaggagatcaaggtgcattatcctaatattcctatcgtggtgttgacgcctttctccaaagaagtttccaaacgtattgcaaatgaagacctgagtgcgatcgactatgtgttcagttggctggggaatgccgaactgttgctggctattattaaacttattgaagataagtggaatgcgcccgacgatacgaaaagtgtaggcgtgcagatcattctgttggtggaagattcgatccgtttctactcttccgctttgccgcatttgtataagtttgtattggaacagagccagatgtttgctaaggaggcgcttaacggtcaccagcagacgcttcgtatgcgtggccgtcctaaaatcaaattggcacgaacctatgaggaggctgtccgtattttcgaccagtaccgggataatatgctcggtatcgtttcggatatgagttttatgcataatggagtgaaagatccttatgccggttataagttcgggcagtatgttcgtaagacgggattgattattccttttgtcctggagtcgtcggagtcgtgcaataaagtatatgcgaaagagttgggtgcgtcgttcatcgataagaattcgaagagttatccgcaggatctccgtaagaagattatgcagcgtttcgggtttggcgatttcgtgatcctgaatccgcagaccaaagaagagatcatgcgtatcaaggatttgaaggacttgcagaagaaagtctttcagatcccggacgactcgctggtttatcatctttcgcgcaatcatttctcacgcttcttctactcgcgtgccatgtttccgccggctgaggtcctgaagcgggtggacgtgagcgattataaagatatggacgaggctcgtaaactgatattcgacctgattgtacaataccgccggatgaagaactccggggtggtggctatttatcagaaagatcgtttcgacgagtacagtaactttgcccgtatcggcgacggttcgctgggaggaaaggggagaggccttgcttttatgggagcgatggtgaaacgttatccaaaattggagacggaaaacttcaataccaacataccgaagacggtagtaatatgtaccgatatcttcgacgaatttatggagacgaatgagttgttacctatcgctttgggggatgccgacgatgagacgatccttaaatatttccttcgtgccagtctgccagccagcctgatcgatgacttgatggctttcttcgatgtagtgaagagtccgatagccgtccgctcgtccagtttgcttgaagattcgcattatcaacctttcgccggtatttattctacttatatgattccccggatggaggataaatatgagatgttgcgtattttgagcgatgcgatcaaggcggtgtatgcttccgtgttctatcgtgacagtaaggcatatatgacggcaacttccaacctgatcgatcaggagaagatggcgatcgtattgcaggaagtggtcggcaaccgttacaacgatcatttctacccgaccatctccggggtggcccgatcactgaatttctacccgatcggtaacgagaaggcggaagacggtatagccaatattgccctcggactgggaaaatatatcgttgacggcggtcaaactttgcgtttctccccgcgccatccgcataatattttgcagatgagtacgatggatttcgcccttcgtgagacgcagacccgtttctatgcgctcgacttggagaacctggcgcagcagttctctatcgacgactctttcaatctgttgcgcctgaaccttaaggatgccgatgccgacggctctttgaaatatatcgtttctacttacgacccgtacgatcagatcattcgtgacggttattattccggagggcggaaaatcctctctttcgtcaatatcctgcaacatgatgtattcccgttggcaaagaccttggatgaattgcttcgtatcgggcaggaggaaatggggcgtccggttgagatcgagtttgctgtaaatgtcgaccccaacaatcatgataaggcgactttctatctgcttcagatccgtccgatcgtcgataacaaggagattatggatgaagacttgaccctggttaagaatgaagagacaatcctttcttcaaccagtgtactggggcatggtatcgtaacggacgtacaggatattatctatgtaaagagcggtgctttcaattcttcaaacaaccagttgatcgcttacgagatagaaaagctgaaccgccgcttcacggaagaggaaaagaactatgtattggtcggccccggacgttggggtagcagtgaccactggttaggtatcccggtgaagtggccgcatatcagtaatgcccgtgtgattgtggaatgtggtctggagaactatcgtgtcgacccgagccagggaacgcatttcttccagaacctgacctctttcggtgtaggttacttcacaatcaatcctttcaaaggcgacggctggttcgatgaagcgtatctgaatactttaccggctgtcgaggatacggaatatcttcgacatgtccatttcgacaagccgatagttataaagatggacggaaagaagagtctgggggtagtgcttaagccggacaatctttcgtgatttataccctttaattcttttctgtattaatttttgttttacatttgcaaatgggtggtaacgcatgaaaactaaacgttgtatagattatccccgtttttgggtgtttctagtatttgaacgacaagaataagagatggatggaagagaatgaagtagattcgaaagacaatgataatgactctctagaagaggaaatatccagattgataaaagagcaatacctgtttacgaaaagtatttatgcttacctgcctgtgggtattgaaatttatgatgcaaacggtgtgttgcgcagtataaatgatcatgcactgcgcatgtacggtgttaaggaccaggctatggtcgttggcattgtcaacctcttcaatagtccttatgtcgacgatttgcttgaagcgagaataagatcagggaaggagaagatcgacttggagtttgaatatgacttcgaccggataaatagtgatgaatacttttcttccagcaataaaaatacaataatttacgatgctcagattgtagcaataaaaagtaaaaaggggaacattatcggacatatattgctgacaaacgatgtaacagcagtaaaagaagaagaatttcgtacggaagagaccaagaagaacctggaaatggctatggatgccgccaatatgtcgtcctgggtgtatgatgtgcataagaaaacctatagtccgttatatggaaatgccattgcaaaagtaaatatgacggcggatgaggtaatgaagatgttgcatccactggatcatgctccattggatcagcttttttcccgattgataaataaagaaatcgaaaccggacaaataacattgcgtttttacaatgatcaggagaagcagtatcatttttatgagagtagaatgcggctatcatccgagcattttggtaaattgctgattatcggaacgcaactggatgtaacggaaaagattcagatggcgaagaagacacaggacctgatagccaagcgtgaacttgcgatgaaggtcagcaacatcgttcattgggattttgatgtgcagacggggaaatttgaatcctataatgatcccgtcaatgattacgagagtagcaggttgctgggagtaaacgaatatctggaggttattcatccggacgatcgctcttctttttatgatgccatgcagtctatgttggcaggcgaaaacagtacgatcaactttacctgccggatacaaacgaagtatgatgaggaatggcagtattgtgactttatgggggttcctttcgaaatggatgaaaataataatatcatacgttttactgggttcaggcagaatattcctaagttgcagaaactgaatagggaactcagggaaaggaatagcaggatagagctttcttttaagacggtaggtatgtcttactgggattttgatgtgaagagcaacctgttcagggctttcaatgatccggtaaacgattatcattcggggaagacaattatgcctgaagaatatctgaaagcggcctgtccggatgatctcgattttgtccgtgggtttatcagtcatatgcaacaggggattgacaaagatttcagcctgaagtatcgctccaagactaagtgggatgatgagtggcagaccttgctcattaccggtatccaggtcgacagaagcccggatgggcatgtcacccgttacaccgggataacgatcaacaatacgaaatgggagaagatgatccgggaactaaaggaaatgaaagagaaggcggaactttccgatcggctcaaatctgcttttcttgccaatatgagtcatgagatacgcacgcccttaaatgcgattgttggcttctccgaactattaacgacttgcgatgatccggaggagaaggaagaatatgtaagtatcattcaatctaataatgagttattgctccggttaattaacgatattctggatctatccaaaattgaatcgggtataattgaacgtagagaagaacagtttaatctggtaaaagtttacgatgaattatatacaactatcctaccgaaggtggctgacaactctgctgttgaattgcggcaggatgattccgttccgaattgttcggtcgttctggatagaagccggcttaagcaggtatggatgaatttcctaaccaatgccgtgaaatgtactaaaaccggatatataaaaatgggatactcgattgaaggcgaaggtctccggatatatgtagaagatacaggagtcggtattccggaagaaaagcacgataaggtttttgcccggttcgagaaactgaatgagtttgcgcaaggtacagggttagggttaactatttccaaagcgattgtagaatcggctggaggagaggtcggatttacttcgactcctggtgttggatctacattctgggcctggttcccttgttcctcagaattggttgaacaataaaaaaatagagccctcttcgttttaagcggagagggctttatttttatgtaagaatagaatcagtcttttttcttaataaagtctgaagggtagttcaccttgttaatgatttcgttgtttttcagacgtatccaagttttgaagcccttttcaccttctgtcatttcgatcacacgggcaccgttggtcaggttgttataaacagtgtcgccaccggtataacgaccgtaagccaataagatgcctttccagtaaacggcataatcgtcatcatggtcgtgaccgacaaatatgccttcaatgtctcccatctctttcatggaagcaaacagaccggagttcagttgcggtgcacaagccttttccttacgtgttcctaccattatagcagtttcgtctgaagcagcctgattgtattccggtaaagcgatatggaagaaagccaatgaaggaactggtgttccaccgttctgctttgtgaatttggtactgttgtcgcgataccattgaacctggtcgaacttgatgtaatcgtatccgccgatcccttcgatctgtgaatacgaatgagagtccatacaataaagcacgactgcatctttatttccattcgacgatttgatcggcaggatgtagttgctggctccggatacccctttcactgagtctgtcaggttgtacgggattgttcggataatatcaaacaactgtgtacgcgtcagtccctgttcgttgtcatggttgccgaatgtcataccgaaaggtattttgcgcttggctgccaggttgagtatagtgcgcataccttcttcggcaggttttccgtagataacgtcaccggtgaagagtaccagatccggcttctccgcatccaatacttcgttgatcctctcaatagagattgccgatttcggattgttgtggatataatgtacgtccgtaaactgtacgatcttgaattttccgtctttattgaatttcagtgacggttgttgggcgttaccgttcagtaagccgcccaacaggaataacatgctaaataatatctgtttcatcatctatttatttaaataccggcatcggacgtccgatccaaacttgcggttgtttcaggttgaaaatttcagcaacggtagaagcgcagtcgaactgcatcatgctgatgtcatcgaagcaatatccttttttgatatttttaccggcgatgataaaaggagtctccatttcctgcatagtcttaccgccatgtcctttgttgatgccaccgtgatcggctgtgatgatgaaaatcgtatcgtcgtacataccggcttttttcacggcatcgacgatccggccgatataagtgtccagttcttttatatttgcataataagcaggagtgtcgtgtccgtctgcatgtcctacatggtcgggattgtcaaaaacgatcaaggcaagagtcggttttttctcggtgatgtatttaacggccatttcgcataatgcggtcggttgtttgttatagtcagggccttgtgcatgatagctcatagacagggtatcgacgagatatttaataccgtcccagtcgtaaaggcaaccgatctccgcatccggctgggcatcacgaagcaattggaaaaccgtcgggaaaataccatgtttattcagttcgcgtgaaggtagttcaggtgtttttgatccccattctgtgtatccgtggatctccgggcccgcacccatgaacatggaagcccagttcactgcactggaagatggcagtacagaacgtttcttcaatgtataagaaccgtctttcataaattgtttggtgacaggcatctccgccttttctacactgtaagctccccagccgtcaaggccgatccagactacatgttttgctttgggtttggcggcaaaagccgagctgacggtgaaaatggttaaaaccagaataagcaataagtttctttttttcatgatatgtgtttatttttgtattagtacatcaaaggtatgtaaaatagggacgaatacccaattcccatagcttcttttatcattattttatagtaatatcgaattgatcgtacgactcggttctccaggatttatcggctgttgtcggcgaaattgcgaaaagcggggagaacgtttttatcttgattgtctgaccgtcaggcataaattccatgatacgcaaccagccgtcgccaccgttgccatgccagaagccgtcagctgtctgtgcgttgaacatcatctgtggtatctctttgccgtcagcattcttatctatacggaaagcgacgttatccttgaaaggagctatctcgcattcgtgaccgcagatcaccatgcagatgttggaagagggatacacgagtttctgccagatggcttccccgtaatttgccggagatactttgtagttctcttttatgtggcgtttaccgttccatgccaggaatgagtgggtcaggagaataaccttatgatctttgtacttaggtttttcagtgactgtctttgcccattcgatggcttcatcgcgtggtgcgaattccagggagatgacaagtattttgccccaggtcttcgtgtcgaattcgtatgctgcattttcaagcgtagggatatcctgatagttgtttcctacttctaccagtgattttctccaacaggagtttctttccgatgggaaataggtcgggaagcggcataaacggttttcagacttttcgtatccgtagtcatgattcccggtacagataacgtatggtaatttattgtccaagcgggcaaaggcctgcgaggctgctttccattgttcttcgctggtctggttgccgttcactccgtccggaatacggatctcgttctgttcaaccaggtcgccggtacataacacggcttcgatattcagtctttctttgttgttggctgtccatgccgtcatcagttcgaacaacggctggttgacatcgaacttggtgtagctctggggatcgggcaacaaaatcatggagaacgactgcccgttcgttaatttaggttgtacaggttgtacctgtgcattcattgtcatcagattcagtaaggcgatgactgataagaataatccttttttcatttgtatttcgtttaatgtattatttgtcggaaggaggcgtcagttcaaatgtagtcaggactgctgcatggtcggaagcccatacgtcgtctatctccggtgttgttttaatgattttggaagcgacagcctttatgccttttcctttgtagaaaagaaaatcgatccggctgacttgcagttgtccgtagataacggcaaaggtaccttccgggcggcgtatttcatccggattgatctcgcggaaactgtccttataaccttcttcctgcatataaattgtagtggggaaggggacagggccgtatccgtagtggatgggtgctgcggcagcagtccagtccagatggctgcaggaattgaaatcacctccgataataacgggggtgtcatcgtctgtcagatagggtttcgtgtctttttcgaggatatgtttcatgtcgatcaatgcaaggatagagtcttctgctacccagatacgcggatcatgtccgctgttcgggtagttacaggagtattccggccggtaggcatatcgtagccaacaggcatttaccagtagttgacgtccgttgggtaatgtgatcttcgccggattggaattgaaagtcttctctgtcggaatgctggttagcggataccggctgaagagtacaaggttatctttcaaagagggtgtctgcatgttatagccgagcgagtctttaaaacgttgttgtccgccatagccttcctgcatggtaatgatatctgcattggatgcctttaacaggtcgatgatccggctccgtccgtcatttcctacatgctggcctccgtgccagatattccattgcaggactttgacgatattgggattgctgctgttgcaggttattcttttttctatttgtccttcacttgtctcagggatatagttcgttttatccagtttaaaggaggggacattgattttaatcttattgccaaaggtcgctttgtcggatatatcggcggtaacgagcagataattgataccgggtgtcagctcaatcgcccctttagatgctttgaatgtcatctttcctttgggagctttcccatttccgaataattccgtgcgtgtgtctgaacgggcgtttttgccggtataatatatatgtacgcgagaaatatcagcaaaagaagtcatctcagacagatctaacgacagttctgtcaatgatagaggggattgagtacctgtgacagctatcctcagtttcagtatctgatcgtcctgtgttccctggtcggcatcccattcgctgtctatgacgacggcattaaataattcctgcggcttatcgggtgtatgaataaatttaggattgtcattgacaacggtataagccatagggattgtccctttgtaatcgacccgtccgtttcgtatgtgataggcctgatctccttttccaacccagttaacggaaacatcgtctatcccgtcatcaaagttgtaataagcaattaatgttttgaactgcggatgggtcggggcaagaggcttattcatccatgcctgtatcgtttcggtcggcaaggctgaattccaaacacggacttcatccataaggcctccgaaagaggtggagtcactttcattgatacccaaagctcccggtaaaacggaaacggcaacaggcttgctgtctatcacttcaccatccagatacagtttggtggcagtgccatcacaactaagggctatatgatgccattgatcatccaatacattttccgaccataggtctgcctgagtactgtgaagttttcctttttcaataacaagaggaagataatcggttatattcagttggctgtattctccgcctccgaaaatgatttcctgatctttccaggatttgtcatctccttttatccaggtttcaagtgtccagggggcgttgagtattcggatgccggttcgtacgttattgtctttcccgtcgagatgcaaggcgaggttgagggtgggggattgagctactgatgtgataacaacagaatagagaaagaaaaagataaataaatgtctcatcctaaagaatgattccttttgcttcagatatttcatgatattagcgtaatgtgtttttatgtttccaaaggtaattgttttatatggaaaagggataggatttctcctatccctcataattattcatgacataaaacaaagactgttagtatttatattctaagtagaatataacattctccgttttatttcaatatccacattacatcattgatattatcatttccactaaactgacgactcagtgcttcttccagattttcacgattgtagttatattctctttcagggtacatataacgaaccggtatacgatccggggctgttacatttttacttgattctggattgattggtaatacagggtaaccggttcttctataatcgtaataagcctcataagtgtgttgcagataatatgaaatatatttctgggtgatgatcttttccagatccttttcaaaagaacctgtcagttgtattttgtcattagccaggtaagatgtgatataatcattagttataacacgcccgtgtgcatattcgtctggagtataatctctgacaaatttcatatgagcttcaataccttttttatagtaatcactagcgttaccactgatccagccgcgcaggcaagcttctgccagcaggaattgctgttcactgtatcccaagcgtatcagcggttcaccttctacatgactttcagagatgtaacggaggtttggcctgcaaaataaattggcaccatgtgctttcgatacctctccataaggaagagacgggtcaacaccaacataagcttcaaaatcgctttcctctttgccttcgtttattttggcaatggaaggttctccatagtaaaacaaacgataatctccatattcagtcatttggtcaaccaatacagatgacatcattgcatattttgtctggttagaagtcaaatcgttgaaaggatatttcattccttgctgatctttgtaaaccaattgaaagttatcagcattggatgtcattaaggagccattctgaatgattccggcaaaacgtgattttaagttcaaatcagattcattttccttttttgaaagattcattaatactttcaattggaacgcagtgactgtttttttccagttgtctttattcccattgaaaataatatctccttcgaaagccatatcatcagcatcggagaagcattgataagctttttccagatcgttgagaatgccttgcatgacttctttctgagtttcgtatttcggacggggattaccttcttctccttggccggcattgctatatggtatatctcctatatttaatgaaatataataaagcaaatatgcttttgagaaaagggctaatccttcgtaacctttttgtccgggtgacttagttaccatatcgttgcagttgaccacttgtaggaaaccatcgaaatcgccacgtccgatattgttatattgcaagtcagaaacaccttcgttccatacgatttgtttagctaatacaccgtcgtttacatattccttcacggtacggtctttacgaacaacttcataaataactttggttgccagcatggaagatggaactgtcgttgcggtgtccggatctgtatttagtttttcaaaattatcacaacctgtaaatatagatagcgatgtgaataataacagtaatttatttatatgtttcataataactcagtttttaaaaatcaagtttaatattcaaaccaacatagcgcatagaaggagcgtttagtaactcagcgtgatcttccgtgatagcatccggatccgaatatttgaaatctttgctccagatgaacaggttttgtcctactaaagagaggtggatattatcgaaaccgatcttttgagctgcttctcccggcaatttgtatccgatagacaattcgcgcagtttaagaaatgtcaggtcatgaatgttctgaattcttttactaccattccatggctggtaatttttggtataggcttcgtaagatgtggcgacgtcgtttggagcgaatacacgtgtgtcttccagaatatttccgtaagagtcatattttacagaaccggaaacgacttttacaccctggcctacataatttgtttttccgtttacaacttcgtcgtaacgccattgattatcgctgtcaatatgtgttccggaattccacatagcttgttccagacgattgtaagctttacctccgacacgtccgtcaaaagatacatcaagagtaaagtttttatagctcagatgattggtgaacccccatacccagttagggcgttcgaaaccggcttttgttggatagtcgcttaatacaggcatacctccactatgtacaatgttgccttgtggatctctttcccaatcatacacttcgaaccagtcccagcgttcgccagctttaacccagggtctgtcggttgaataagtctcatctatcttatgataatagtaacggtcgcgtccccagttgaaggaagaggtccagttccaatctttcgttttgataatatcaccggatacggtaatttcccatccttttttgatacgctcttcatcataattatttaaagttttctcaaaaccggaagtatagcttaaaggtgattcgtgctggatatcagtcattaactttgtatagtaagctacatcgaaacgtaaacgattgcttaagaaatgagcggcagcacccacttcaaatgatgttgatttttgaggaaccagtgtggcgtcacggagcatagccgggtatgcggcagtagatttgctgtcccatacattttgtgtgattttgtatactttattgatatcatatatatcggcagccgttttagttatggtccatgaacttcttaatttcaaaaagctcaggtagtcagacatgtcgaccaattctgaaaggataatactaccggatacggatggatagaagtatgactgttctgatttagccagtgttgaaacccagtcgttacggcctgtggcttcgatgaaaattgcatttttccaggataagtcgattttaccataaacactgtttgtctgtttcgtttttacagtggttgatacagatggaagatccttcgatgcttttaacgaataaaatccgggaacggtcagtcctccgtttgtattggcatcaaactcgtctttttggtaatagtttaatcccatacctaacattccgccaacattgaagtcgccaacttttttatctgcaatcaacagaacgtcgcctatgataccatatcctctacgttcatatttctcaaatttaccagtctggctgttacgggcgctcagaggtatcttgtattcaaattttctagagtaagtatcagaacctacacgtgccgttgctttcaaccaatccaaaatttcgtagttgagcgtagcttgtgcattggcacggttttccaattgcgattttgtcgcttcgtttgccaggaaataaggattgttataatcgtatttgtataaccagttttgttcgatatcttctttgccttctttccaatagtttttgaattcgcgaatatcgaattcggtacctgtccatacgatcatattgtagaggtatccgtcccaaccatatccttctcctctgaattgcgggctgtagctaccattgtaagtgatagaggcatccagggaaaacttgccgaacttcatatctccggcaacggtataagtgaaatcgtttaatttatttccaggaaattgccctttgttgtatacatgtgtcagtgaggttctgaaactaccgtttttacctttatacgtgacattcacgttgttgttggtaacaaaagatgtttccagtaaattgttgaaattatccttcccttttgataccaaaggcatttctctccattcatatgttttggggtcgtattggacagcagttcttcctatatccagtttgtcaccccaaatatattcactcaactcttgcaggtacttgcctcctgaaccgctactataggatgattgtacttcgggcaataccagatagccggcgttgaacatcgtattactgttcacactgactgccagaccttcttttgttccacgctttgttgttatcataatagctcctgaagctcctttttcgccgtaaagggcagaagctgtcgcacctttcaatacactcatcgattcgatatcgtcggcggccacatcgcttaatcctgtgttttcaaacggaataccatcaattacgataagaggtttttctccacgcaacaagattgttgaactttcattaaatgcgtttgtgttgatgacagaaacaccggctatttttccggaaagggaagttgctatgtcggctccttttactgttgtgaattcatctcctccgactttctgaaccgaataacccaatgctttttccgaacgtttgatacctaacgctgttactactacttcttccagtagttctgtatcttccgataatgtgatttttatcatcgattgttcgcctactggaatttccttgctggcatatccgatgtaggaaataatcaatatggctttgttgggtacagacaaattaaattttccatctatatctgtaatggttccgttggtagaacctttctctaccacattagctccaataatcggctcacctttggcatcagtaatcgttccggagatatttttaatggactgttgcactattgcttcgcttagaacttctttcggagaaagaatgatgctcttatccagtactttgtagctgatatctgttccgttgaacaattgctccaatacattgaatacatttttccggttgctttttatggaaacgacacggtttgtatttacctgtttgttgttgtagaagaaatggaattccgattgtttttctatttcgtctaaaacatcctgaactgttttattattaacgttcagggttaatgttgccgattgactgtaactttcggatgcgtatgccaatcctatgcatacaaatagcattattgcagtgagtctcatacataatggtatttttttcaggacaataaacgatggattcaccatcctgaaatgttggatgctaaaataatttgtcatagatttgtaagtgattttagagttaaaaaattcatttgcttatgcttgtcgccaaacaagcctgcagttggttttcatacgggaaaatacgccaatatttttccgtatgttttgttttaaggaggtactgtctctttcatactgtatttacttaggttacacaaaaaattaatatagttcaacaattgttttttctgaaatttttcctttgtcctgattgacttccggatctataaacttatattgaatgccggatgataaccggaagtgctcgagaataagcgtaagatgctgtccactgaaagttccggtgaaagagttttcatacaacaggtcgttcttcacgataaattcggtattgaaacgtttgcttagtacctttagagcctcttcaaaagaggtgtttctgaaaataaccagaccgtctttccaagctatttgggtaggtaaataagacgtattagttttaatccccttggtctttatattataggatatttcatcatccggtttcatgataaacgattcttccttattctccctgttacggaaagatagcctgaccgagcccgaaatcagagaagtggtaacttggttgctttctctatatgcttccatattaaattctgttcccagaacttctgctttcaggtcgaaaggcgtattcacgataaatctctttgatttatctttctgtacggagaaatatgcttccccattcagttcgacttctcgaatgtcgccagtgaaatgtttaggatgctttagataagatccggagttcagccaaaccttacttccgtcgggaaggtcgagggccgcaaccatgccgggatttgtttttacttcaatgtattcgaccggttcttttttcgttgcaaagtaaatcatactgatcaataatggaagaataagtatggctgccactctttggaaccagatgaggaaattcgttttatttgatttgtgaaatcttttctttacctgttccaatgcttccgccgaatttacttttttaatcgtataaagtgtgtcgctagcagcatagatatactgaatgtcccgtccaatttttcggttttcttcggattcttgcagccattgttccacttcctgcttttgatcagcgggtaacgcccctgtataatagttcagaagtatatgttcgtctatatgtttttgcttgtccattttctctcttttatattaaagactaatgaacgcaagaacctcctaaatggaaagatgtattttttttgatttgtgaaagagttctagtaagactaattcgattatctctgcaaaaataacatttttcaacacattggctattacaatgcgattaagtttatcgaatattaaacaaatgcaagccttcgaatggctaaacaagccaaataagcaatcattttcaccatagtcttactagaacttaatccataatttgctatatgctttctaaaatcacagataaaacaatagacgaggttctttttgaaaagatccagtctggtgatgtgaaagcatttgatgtcttgtttatgcgttattatcctttattatgtgcctacgcaaaacaatttgtagattttgacgatggtcaggagattgtacaggatgtcatggtctggttctgggagaatagttctatgcaggtgatcgagtcctctccgaagaattatctgtttagagctgtgaaaaacagatgtcttaccctgataaataggaatgaattaaaacagcggattgtggattctatgtctgtcaatatgcaatcgcagtatgaagatcctgatttttatgtggtggaagaattaacccggaatatagaagcagccttggctcgcctgccggaaacgtatcgagaggcctttgagatgaaccgtttccaaaatatgacttaccatgagatcgccgaaaaattgaatgtctcgtctaaaacggtcgattatcgtattcagcaggcattaaaactattgcgtgtggaactaaaagactatttacccttgttaatggccttagtcagaattgtctgaaacacttccggctaaagccatcttattttattacaaactttttacccattcttccgcttttgccaaagcttccggtttgccaatatcgagcagtcgcagattttcggctgcataagcatgaatattggcctttgcgcagatcgacaggtagaaattgataatcgggaatttacctgtccactcttccatccagtcaaatatctgcggagataatacatgaacaccactgaaggcgtattcattatataatttgggatcgaaatcgggataataagattttacttctcctgtctcatggtttctccatccgcacagacggttctcgttgttgaaaagaaggtaacgcgatgtgttccgtttgctaaccagtaaggtggctaacggttttgtttccaggtgacagtcgtataactttttcaggtcgacattcgacatgatgtcgacgttgtgcaccaggaaaggttcgtttccctgaaggaatttagccgcattttttatgccgcctccggtgtcgagaagatatccacgttcgtcggatatatggatctggatgccgaaattgttattagctgccaggaaatcaatgatctggtctcccaggtggtgaatgttaataacgatctggtgaaaccctgcatccttcagtttaaggatcacatgttccaacattggtcttccattgattggtatcaatgcttttggggtattgtcggtcatcggtttgaggcgagtccccataccggctgcgaaaatcatagctttcataatattgcgtcaaagatttgttctatattttgttccctgtgggtcaagtctacttttactccgaatttggcatgcagatgctctgccagatgctgtgccgaataaacggaacgatgttgtccgccggtacaaccgaaggaaaccatcagattcgtaaagccacgatccaggtatcgtttcactgaagcatctacaatattatatacatgctcgaggaattgcgtaatttcaccgtcttcttccagaaaacggataaccggctcgtcaagccctgtaaagtgattgtatcgctcatatttaccggggttattaatagcacggcagtcgaaaacaaagcctccgccgtttccgctcggatcgttggggatgccctttttataagagaaactgacgattttaacttccagcatccgcttttttatatcgtccctgaactgtgtcagtccggtcaactcccttaatacggaacagagatagggatattcggaataatcgttcttcaatagctggcgcaggttattgatcgcaaaaggaacactttggatgaaatgtggtttcttttcaaaatacccccggaaaccgtaggcgcccaatacctgtaaagtcctgaacaggacgaaatgacgtagctgactgaagaaatgttcttcatctacatctgtatattttcgtagtgcctgcaaataatcggcaagcagttcgtttcttaaatcttccggataattggctttggcctgccagaggaaagaggcgacatcgtaataaaccggccctttccgtccaccctgaaaatcaatgaaccagggttcgccatccttcaccatcacatttcgcgactggaaatccctgtacaggaaagtaggagtagtgtcgcgcaataagacatcgctcatcttctggaagtcatcttccaggcggtcttcctgaaattccatgcctgttgctttcagaaaacagtatttgaagtaattcaggtcccagaggattgaacgctggttgaattccggctgtggataacattcgttgtaattaaacccatcggctcctgcatactggatggaaggaagcatggtaattgttttatgtaataactcacgttcctgttcatcgaatacacaacttttacgtcctttttcaatggcgttgaaaagcattgtgtctcccaggtcttcctgtaggtagaaagaatagtcttcagaatgaaaacgtacttccgggacggaaatacctttctctctgaaaaaaccggacatataaataaaagccttgttttcttcctgtgaagatccgctgactccgatcaacgtttcaggtcccgatattctgaaatacctgcggtttgatccggatgagggtagttctgtgatgtcttcggcctgtgaaccggtatattcgtagtagagtctttttaattcttctgttaccatactttgtttaattacggcactaaggtaatagttttttgtcaggagaggaaacttaatcaaaaacattcactttcgtatttggatttagtgcttttgtagttcaagtatcaaaatgttatttatactggtatataggagagctatacgggcaaaaggacagcgtgggtggattctgtgagattctccgggaggatattgttgttaaatagtgcggttttaatatggaaatatgataaatagatgttgtttgttggcttgttgtgcttgttttgttttgtgaaattgatatttaagatgtttatgatattttgtttctgatgtgttttaaaggcgctctgtgataaaaaactgccgaaaaacatgccgtttgagtgggaaaaagcctttgttaatccttcttgcaacactttttaactgtattcccgttttaaatgaacctccattttgtttaaaacaaaaaaaatctcgttttaaacgaacttgtaattcctttaaaacgaggttttgaaaatgattctggggggatatttgttaattattgtaatggtaagtcttctataaacgttcttaggaaagattactgtgtttttgtttctttgaaatgtgtgtcatattgttgttttagggtgattattcgaatcgttttgttataaatagcttccgtttgtgattgccaatatagtgaaagcttcattcattattactatgtttttctttgaaaaggcaatctttaataacgcatgtaacatcttggcattaaaaagactagttttgtacaatatgcatgattataagtatctttagcgtttcttattgcatctgcgaatttaaaaaatcatatctttgtagttagtattaataatatgtataaaccaaaagggaaaatatatgaataaaaaatctactttaatagccgctgctttgatggcggtaagttcgttgacggttagtgcagaggacgctaagccggttccttcgacggaatgggcagggaacaattattatcatctgcagattggaacaaaatcttatctggctatatctccggagaaccgagattcggttgtgctggaagaaaagctgggtacaaccaaagaggctattgatttgactctttggaaaattgtttatgctggaacggaaacatcgtctaatgtatatcagtttgttaataaaaagactaaacaagtgttgtcttttgcaaaagatttggatggtgatcctattttagcagaaggtattgataaatggtctttttcagaggatggaaaagggtttatttctgcaaaggtgaatagttcggagacgatgacgctgagtagagatgataaagagaaaatcgtatttaaaggtggtacgcaaatgactttttctgttgtggctcctgaggtatcttattcggtaaaaccatctgaattaggagacggctttactacattccaactttctttcggcgaagagtttgaaggtgatattttcagtggaaaggatttgattgccgtaacgaagtatgacggtaacattgacgatgactacttcatgttgcaggaaaaaggagatgaagcgtatgccgatggggtaaagaaattcttaggtgtagacacattgacagtagaaggagccgggaatagtttttcattagattccatacgcacgacaattaagccgaacaaagatgctaaactatttaagtttacggcagatttgaagaatgattcgttgacaatgatcgttaagagtgttcctgcaatggagaatgcgaaggaagcagaagctgcaaagcatgttgtttatgctcagctggggacaaagaaagtgttgacaattggaggcgtagatgatattcacccattcattacggctagccggggtgttccggcagaaatttccggtggtacgggtgtctattttctgaagagcgccagtaagggagctatgggtggaaaatatatatcgtcttatgatgaaagcgaacggaaaataaaggtaatggccggtactccttctgtcaatcagcttgaaggacagtggtatataaaagaagataatggaatgtatagcattgtagatcgtaaaagtaatacatctatattgctgaaaggtgaagttttcgctgttcagggaatagctaatacttttacattcggtggcagtgcagattctattaccgttgaacctcagaaagtaaatttagatgataagtatttgggttctcttcatttttcaaaagaagatttagcaaataatggttatgttttgaatttgcttcctgcaggtgcagaaacaagtaattcatatacttttacttctgattctttactgaaggttacaacaggtgatgctaaagatgctgttctctttaaattagattctgtaggagttagtttgaaggaaggagcacaaaaattaaatgatactgtttctgtagttacttacaaattgaaatctcagtttagcaataaatatgtagcatatgataaagataaaaaatgcttgaagatttctacagagcctaaggatgccattgtgttccgttttaatacaagtacggatggtggtaaatatgatatgaaagttgtatctggtgaaaatgttacagcaaataaatatatttcagctgatttagcttcatcaaacatggtgctgtcagaaactccggcgtatttcaatttcgttgaaatggaagctcctgaatacggcacatttgattctggtaacaaacgatttacttcagatctgaagtcgttaacaatgaatccgttcagccgttttgcagaagcaaagcaggaaggacaggatatcttgaaatcaacttatgaaaaggacaactttagcttgtggttgagtaaatcaaaggcttctactgctgagaaaccgttgtattttattatgacttcattggctgttgatggtgatccgaatgctagtagacattatttttatatggtttctggccgcgattcttcattagttgatacatctgcagataagaattatcgtgttcactttattaaaaacgatacaattgaaacaatgaaggataatgctaacaatcctgctttgtttgcattaaaagtgacagaaagcggtaactatctgctagaaaatcagaaggagttaaatagtactgaaaaaagtgcaccatatgtaggtatcataaataacgttgtagttatgacaaaagacggtgttgagttctctgttgaaactgctcctgctcctgttgccaacgaagaaatcgaagctcctaatacagttaaagtaataggtggcgttggtgaattcagtatccgtaatgcacatggaaagaagatcacagtgtcgaacatcctgggccagacaatcgctacacgtgttgtttcatctgactatgttacagttccgacaacaagaggtgtcgtgattgtatctgtcgatggcgatcaggcttataaagtaattgttaagtaagaattacctgataaataaaaaaatagcggatgatttttcatccgctatttttttatttattcgtttttgatattctctttatattgtgtaggtgtactgcctgtgtactgcttgaaagccgtactgaaataacgggctgtagagaatccaacctctgttgttatctctgttatattcatctccgttgtagccagcaagttgattgccttttccatccttagtttattgatataatccgctatgcccatattggttatcgctttcattttattgtacagcgaagaacggctcataccgatttctttgcaaagcaaaggcacgtcaagggaaggattcgtcaggttgtcggtgatcaccctattgagtttaagcaggaactgttcatccgtattactgaaagtcgtttcttgcggttgaggaataaatccggctttcagatacctgttctttatgtgttcccgattaatcaacaaactgcggatgcgttcctgaagcgtatccatgtcgaaaggtttgactaaataaccgtcggctccattcttataacccagcgaacggcttttctcatcgtcacgagctgtaagaagtataaccggaatatggctgatctctatatcttctttgatcgctttacacaactcataaccatccatctggggcatcataatgtcgctgaccaggatatccggttgcttgtctttgacgatctgaagagcatccttcccgttcgttgcactatagatctgtttgaattggtcgcgtaaagtctctttcaggaaattgattagttccgtgttgtcctctgccagaagcagcgtgtaattgtccgtcgtccggatgctcaccggtttttcgctgttatcattctcttcataaccggcgataagctcgtttaggtacggtttgggttggtaggtttcgcttatgacatcctgctctaccggcagttcgaagaaaaagatagctccgctctggtcgtctctgtctttcgcttctaggcggccaccatgaagttccgccaggattctggaataagacagtccgataccggaacctccttgctcgttgttcacctggtagaagcgggtgaataatttggtcatatccacatttttcagtccgcatccctggtcggttacagtgatcctcactttcctgttatcgtcacatcgcccggacgaaatgataatttccgtattatctggactatattttacggcatttattaataaattggtgaggatgatctcacatttatgttcgtcgaaaggcacttccccgacttcttcatccagcagataaaccaatcggatctgtttttcattacattctgtaataaagtcttctgaaacagaatgtatccatttattaagcggatgcttttttatctgtaatttattttccccgacctccattttccggacatctagtacggtattgatcaggttcttcattcgttgcgcctggtgataaacacttttcagcggcaggaaatgaacgtcggtttcgggtaatgcctgcaagatacgtttcagcggcgcatgtatcaaagtcagcggcgtacgtagttcgtgactgatattgataaggaaacggactttttcttcatacactttttgctcgtgttccttcatcgcccatttcagttcgtattccttctttcggattgctgaaaagaaaagccacgccagaaggccggatattgcgatcaggcaggataggatgaaccaccaggttttataccagggaggcattaccctgatggaaagcaggctttggggagaagtccagtccccgtctttcttactgcacgaagcggatagattgtagttgccgggaggtaaagagcgtatgatcagttccggtttgtatgagtctatctgttggtcgttcgctcctttgattgtataacggtatatcttcttacggaaaatatctttttcctgcgattgaacctttatcacgatcgatttattattccaggggacggagattcttgcttgtcgctcattaatctctgcgttagccggttccccattgataatgatatcttttagacgtaattccggtatttcgtccgtaccgagaggaatgtctttgtcaatcgccagcaaccctttgatcccgcccatataaaccgaaccgtcttgtccgattaaccggggtttgttcaggtattcattgggttgtatgccatccgattctccgaaaaggataaatttctgttccttaatcaaataagtgaataccattccgtcggcccctatccatactttgtcctgctggtcgcagatgatggagttgataccgctgaacaggcttgtttttatattttgtgattgttggatgatcgggttgtggctgatcagtccgtagttggtgccgatccagaaagtaccgtactggtcgcgcgaaacgacattgatatgattatcctccgggcatttgtaaatccgggagagcttgttggtccggtggttgaactcataaatgctgtagaagtcattcatataagttagataaggattatggtggatggggaggagcgccccggtaatttgttcatcaaactctttttctacctcttcgaaatggccggatgagaccgtataggtatagatattgggatttcccagaaacaggatggtttcaggtgtgttccggtatacgttgaccgcctttccggtatggcacagtgaatgatcgatgctgtcgttgacgatcaagacccgattaagggcggatgtttgtttgttgaagcggaatactccccggttgaatatggtaattaatagttcgctgtctgaaaaaccggtaatagaggctattttatctccccatgtattggagaaatgtttgaacttctcggtggatggattgaatttattaattcctccgccatctgttcctacccaaacgatgcctgaaggttcctgatggagactcagtaccgtattgtcacttatcccgttctcatttcccaaaagggagtgtgtataggttttcatatacacttcgcggatattgatcagaccgtcgcggatagttccagcccacatattattatagttgtctttgtaaaggctaagaaccgaattgactggcaatgaataattatctccggaaatatgctccaggatatggatctcttttttttcgggatcgatgatgttgatacctcctccgtctgttccggcccatatttgcgaatctctttcactcatgcataagatgacattgttgttcagaccggaattggcagttgtatattcttctagtagcttgccgctgcggtcgaagcagcgtatcccctgattataaggggatatccatattctttcccgggagtcgatgagcatggatataatctcgtctccgcaattgaaaggggtgggagaggttttgccggtgtgtctgtctaccaagacaagtcctttccatcgattggagcatagatatgtgtttttatcccatacatagagcgacaatataggatagccatcccggtagttgaaattcagcgataaggacaattcccgggtttgataatcatatttatatatttggttgcggcaaccaaatagcattccgtctggttgttcgcagacggaatgcgcaataatattgcttccgtttttgtctttcattgtgacgaaattgtctgtgtccggcatataaagcgccatccctttttcggtgagtatccagatattatacagtttatcttcgacgatacgtacgatagggtcgtcaggaagtgatagcgggttgttttgttcgtgccggtatttttgcagttcatatccgtcgaatctggccaacccgttttttgtccctatccacacaatcccgttagagtctgtgaaaatgtttttaacagtggaaggaagtccctctttcaacgagatctgtttgaaataataatggctggcctttaccggcaggcaaaaaataaaagagagcagaagtatatttactagtgtgaaagacaatggtgttttcatttgttagattttttctgatcagatacaaatttagtttcttatacaataataagcaagcaataagaccgttaaaatcggttgttaacattcgctgtaatcatgaaatcttaaccggtttgttaataaacaggatatattacgaatccaatattgtccataaaaggtctgaaaatgtccaatatatgctgattgtatacgaaatggaaatttttggatgaatcaaaagaattatcgaacgtggataatatcctttgttccatacatttgtgaccatactttgaaaacaaaaagaataattaatttttagtatcaatttaaatttagttttatgaaaaacctatggaaagtttttctcgcatgctttcttttctttttctcattatctgcaatggggcaggaaaagaatataagcggtaaagttctggatgactttaacgaaagtgttcccggagtaaatgtgcaaatcaaaggtactatgtcgggaaccgtgacggatgcagatggtaattttaatattactgttccgaatgcaaaatcaatactgattttttcttttatcggttatgcaacacaggaagtccctgtgggcaatcagactaaacttactgtaaaactgaaagacgacactcaaaatctggacgaagttgtagtcgtagcttacggtagtacacgtaaaagtgatttaacaggtgcgttgactactttacgtccggatgccaacgatgctgccaaggccagttcgcttgacaatttgttacaaggcaaggtggcaggtttgaatgtgacttcgtctgtttctgctccgggagcggcagcttctgtaacgatccgtggtgcaaactctctgcgtggagataaccagccgttgtatgtgatagacaatgtgccgcaagcttctaccggtgattttgcatcttctgctgtaggtggtgattttcagattgcacaagatccgttgtcttctttgaatccggccgatatcgaaaacatcactgttttaaaagatgcttcggcaacggcaatctacggttcacgtggtgccaatggtgttattcttattacaacgaagaaaggttcgatgggaaaaccgaaggtaaatgtgacggcaaactttacggtagcgaatgcccgcaacttgtatgatatgatgtcattagagcaaaacgcgttgtatcaaaactccaagaaagatgaaaaatcacgtcagttctatctggtagacggacaggtacggtatgtgttcggggataatgtaagtacttatctggcagatcctaacaatcctgagaactaccgggtgctggagtatcgtaactggcagaaggaaatttaccagtctgctttctcccagaattattccgcatcggtgagtggtggttccgataagattcaatattatgtttctgccagttttaaggatattaatggtatcacagtcggaaccggagtcaaacaaggtgacttgcgcacgaacctgacagccgacctttcgaaaacggttaagctgaatctgacgttgaacggttctttgcggcagaatgacatgatggccggcggtaacacgatcggtggtgcgaccagttctatttcacgtactgcattagactattctccttatcaggtaccggatgacgatccgaatatgttgactagccctgacctgaaaacaacggtattcagttggagagacgattatgatgatatcacaaacgataagacctttaagatgggattggatctatcctggaatattatcgaacatttgagttataatcttcgcttaggaggtaacctgaatatgaatgaccgttcacgttggtggggtactcaattgacgttgggtgcaaacgacaatggtatcttgtctttgagcaatacggataaaaataactattcgatcgaaaacctgttaaactggaattcgaatataggtaaagatataactttcggggctacagtcggtattacatacgatgattacgggaacgtagttaagaatacaaaagcaacagacttcgaaattaaaagtttacgtacaaaaggattgcaactggcttcgaaagtggataatcagcagcctattcaaaatgactttcagttattgtcttatctagggcgtgtgaacttcaatttctacgaaaaatatttgttgacggcatctatccgtgcggatggctctagtaaattccgtgaaggcaaacgttggtcctatttcccttctgcatcattagcctggagaatggaacaggaagattttttgaaaaattcggaatggctggatcaaatgaagcttcgtgttggttacggacaaaccggtaaccaaagtatcgatccttattctactttctcggattatggacgtctgattgaatatgcgacagcaaaaggcgaccgcctgttggccttgggggtagacaagctgcaaaatgacggtttacaatgggagcggactacttcatggaatgccggtattgatttcggtttcttccgttcacgcctgaccggtacggttgacttgtatcataagaaaacaagcgatttgttgatttccagaactttgccggcttccagcggttttggcagcgtgatgttgaatcaggggtcattatcgaataaggggcttgaagtttctttgaatggtgaaattatccatatgaaagactggagttggaatatcggtgcaaatattggattcaacaagtcgaccatcggtgatttaggtttcgatcctgctgattttggtgacctgaaacaggttagaggatatttaggaaatacgattggcgaccatttcggtgttgcaaacatcttcctggtcgatcgggctcccggacttttctttggatataaaacagatggtatcgtacaagaagcagatctggctgatggtaaaggggtgaaatatacggctactgacggaagtgcaaaatattacactaaagatcccagttcaggaagtacattccctcatgccggcgctgtaaaatatgtggatatgaatggcgatggcgtgatcgatgaaaacgataagacaattatcggtgatccgaatcctgattttacttatggtttccagacacgtgttacctggaaaagtctttctttctctgcttcatttaatggggtatatggcgctgatcgtttgaatacgaatattcgttataatatgacaccgtccacaaattcaggaaatattacaaaggaggctttcctgaatgcctggactgctgagaatcattcaaatctttacccgagctccacttatctgatgccgaatggtgtagtaatggaccgttatgtagaagatgccagctatttgcgttgctctgacattacggtaaactatatccttccgaaactctggaccaataagatcggttttgaaaatatcagtgtattcgcttctttaaagaatgcatttgtaattacaagttatagcggatacgatcccgaagtgaatagctttgctttcgacggtttgcgtccgggtatcgatatgagcccgtatcccaatgcccgctcttatgtattcggtttaaatgtcacattctaattttaataatctgctataaaatgaaaacgttaaaatatatattgttatgtgcgggtactctttctttttcagcatgtaattcctggctggatgaagatcctcaatacagtatcaacacaaagactgcttttgaaacaaaggaaagcgcacaaatggccttgcaaggatgttatggctatatggcgaatgacaatggatacggacaagcctggcaggagttgatggtgtcggcttccggctttggatggttccagacaaacggtaacgaccaggatgattatacctctttgcgtgctattccggcctcgacccttatcaatatggcttggtcgggtatgtacaaggtgatcggtgaagcgaatgcttttattgccaatatcgaagggagccctttggaggagagcgtcaaacagacgatggttgcagaagctaaatttctgcgtgcattggcttatttcaatgtcgtaactatctggggagatgcgccttttaaaacaactccttctgcatccgacgcggtagcattgccgcgtgtggaaaaagcgactatcctggcacaggtggaacaggattgggtggatgcttttaacgatctgccggagaaagccaatgatgggtttgcttccaaatgggcagccaaagcttttttaggtaaattgtattatacgcaggcttgccagggcgaccaagccggttgggaaaaggcgaaggcttgtttcgacgaggtatataataaaggtgtgtatggtttgcaacctaaattcgctgatttattcgttaacaatgtaacgggttcgaaagagtctatttttcagttgaattattcaagtgcgggggcaaccagtcgtaatcgtggtagctggctttttgcgccgaccaactcgactgccggtaagtcatggagccgtatacgtgcttcgaaggttttatacgattatttcagaggtacttatcccggtgatccccgtttagatgctactttccagtcaaagtggagaaattatacggctaacggacaggtggcgacccaggtagaacctgtttcttctgctcgcgacacaacttatgcttatccgttggtaacgtacgattcaaaagaaactccggaaggatggaataaatcgaagttgttggttgctgaaattccttacgaccaattgcctgatccgacgaacccgagcgcatccgtattaggctccggcaagtatgcgggaatggatgaactgatcaaaaaatatatggagaatacggctgataatcagggatggccttatttcaaaaagcctatcgacctggttgtttcagctcaaaacagccataaaaatatttttgtatatcgttatgccgatatgctgctgatgatggctgatgtctataatgaactgggagataaaaataaagcgatcgacctggcagatgaagtattggcacgtgcacgtcagtcgggtagtgagccttccgatcaaccggcacgttggagtgcttctctgacgaaagaacaggttaaggaaaaaatctattttgaacgtattatggagtttgccggcgaaccggggatgtatcagatcgtacgagcacgcggaacggaaatgcttaaaaaggcattggaactgaataatcaccatgaattggtattattgcatgtctcaaatacatcgacaggagtgaataatttcagggatcgtattttcaacaatggtgatttgagtgaagatttcctgaaaaagaatctattgttgcctataccaaaaaatgagatcgacacaaactctgctataaatttctcagataacaatttcgggtattaaataacgcataggtattagtccgtttaccaggaattgtattaaaaaagtgaggcgcagtaagtctgtgcctcgctttgcttattcgaattattaatttttcaaacgtcagcgatatgaaatcaggtttactctattcattaacgggtactgcggctttgctatctgtgacttcctgttcccagaaaaaagaaaaggaagatgtaaaaaagccttataatattgtctatattatgacggatgatcatacggcacagatgatgagttgctatgatacccgttatatccgcacaccgaacctggacaggatcgctcaggatggcgtaaggtttaccaacagttttgtcaccaattcgttaagcggtccgagccgtgcatgtatggtgacaggaaaattcagtcataaaaatggttttaccgataatacgaattgtgtttttgacagttcgcagcagactatgcccaaactgctgcagaaagccggctatcagacggcgatcgtaggaaagtggcacctggaaagcctgccgaccggatttgatttttgggaaattctgccgggacagggggattattataatccggattttataacctctgataacgatacgattcgtaaacagggatatgtgacgaatatcatcacggatatgagcatcgactggatgcagaacaaacgggatacgggcaaaccattctgcctgtttattcatcataaggcgatccatcgtaactggatggctgatacctgcaacttgggtctgtatgaggacaagactttccagttgcctgataattattacgatacctatgaagggcgtctggctgcggctacacaggaaatgagcgtaatcaaggatatggatcttatctacgatctgaaaatgctgcgtacggataaggatagccgcctgaaaagcttatatgaaaagttttacggacgtatggatgcggaacagaaagccgtttgggataatttctacgatccgatcataaaagacttttatgccaggaatctgaaaggcaaggagctggctgaatggaaatatcagcggtatatgcgtgattatgccaagaccgttaagtcgttggatgataacgttggccgcgtactggattatctgaaagaaaataacctgttggagaatacgctggtggtctatacttccgatcaggggttctatatgggcgaacatggttggttcgataaacgttttatgtacgaggagtctatgcatacccctctgataatgtgtttacctgccggttttgataagcggggagatatttcgcaaatggttcagaatatcgattatgctcctacattcctggaattggccggtgctgaaattcctgctgacatacagggcgaatcgctgttgcctttgctgaaaggggagaatccggaggattggcggacttccatgtattatcatttctatgaatatccggcggaacatatggttaaacggcattatggtgtgcgtaccgaccgttataagctgatccatttctataatgatatcgatagctgggagttgttcgatttacagaatgatcctcatgaaatgaataatgtgtatagtcaaaaggaatatgaacaggttgtaaaggatatgaaacaggaattgctccgattgcaggagaaatatgacgatccgatccgattgacgcaaaatcgataatgacgagattaagctaaaggggttgtctaaaaagtcactcattcgtcctggagaagagtcaaaaatactttttagacagcccctttttatgggattatgataaatctttaattttccgtgttactctccagtttattcttcagataagcgattctgtttgtcgatttatccttttcttttatcagattttccagatcgcttaatactattgccagatcataagttgctgcgatcgcttttttgtcgccatctgcaatatataatgtataaggtttaccacctgtatattctgctttgatacgttcttttacgtttgtggcgataaacttggcagcatcaagacctttttcacctttataagtaacaacctcggttgtctttcccagatccttgaaacggtaatttactccaccgtcgtaagcaatcgaagcagtttcggcaaactgaccgtccggcgtactgacttttaatcctgtatgattgatcggtgcaccgccatagaaaacgctggcaagatagatttcgcctttttcattaactccgctacggatataacaacgttgaacgttccgttctatcgtctgttgtttccagatataattcccgatttcttcgtagacactatctttttcgaaagcgaatccttttttcaaagtctcggcttcttctattttaatagggagcaagctgtcacaaaatgcaatagtccgttccgcctcttttaattcaacctggcgcatcagggccagaccttctttcaaaaccttgtattcttttgggtagagagcacgcagactgtctatttcgctttttgcagcgaagaattcatttctttcgtacatgcttctcgcattatccagtcgggcttgtgcctctttctccgtttggttgcatccagccagggtaatggcggcaaatgcgatacatattgctgacttcttcatgttgtttagcttattcgttctgtctgcaaagatatattttttatctttgcagtctcaatcagtgagataaataaagcgaatgtatatagatcaggaagatattttaaatcatatatcggctaagccgttccacataatatcagaggctgcagacgagttaggtgttgaagcttacgtgattggtggttacgtcagggatatttttttataccgtccttcaaaagatatagatgtagttgcagtaggcagcggaatagaattagcaaaagcagtagctaataagttgggtaaaaagacacatttatccgtgttcaaaaactttggaacggcacaggtaaaatccggtgacctggagattgagtttgtcggtgcccggaaagaatcttacagccatgacagtcggaaaccaatcgtggaagacggtacgcttgaagacgaccagaaccggcgcgattttacgatcaatgcgttggctttgtgcctgaataaagaccgttatggagaactggtggatcctttcggaggtttggatgatatggataatctgattatccgtacgccgctcgatccggatataaccttcagcgatgatccgctgcgtatgatgcgtgctgtccgttttgcatctcaactaggcttctttatccatcccgacacgttcgatgcgatcgagcgtaacaaggaacgaatctccattatatctaaggaacggattgtggatgagttgaataagattgtactttcccccaagccttctgtcggttttgaacttttggataaaagcggattactacaactgatattccctgaattatgtgcactgaaaggcgcagaaacgaaagaagggatcggacataaggataattttgctcatacattaatggtattagaccgtctgagcaaaacaacagataatttgtggcttcgttggagtgcaatctttcatgatatagggaagccggccaccaaacgttttgatcctcgtttgggctggacattccataaccataattttatcggtgagcgtatgctgccgggaattttccgtcgtatgaagctaccgatgaacgaaaagatgaaatatgtccagaaaatggtgactctgcatatgcgtcccattgcgttggcagatgacgaggtgacggactcggctatccgccgtcttcttttcgatgccggagacgacatagacgatttgatgaagctatgcgaagcagatataaccagtaagaacccggagaaagtgcgtcgttttctcaataacttccgtttggttcgtgaaaagctggctgaaatagaagaaaaagaccgggtgcggaattttcagcctcctgtttccggtgaggagattatggaaacatttgcccttcctccttctcaacctgtaggagtgttaaaagaagccatcaaaaatgcaatcctggatggtgtaatacccaatgaatacgaggcagccaaacagtttatgttggaacgggcggcaaagatgggattaactccggtaaaataattaatatccgtaacttaattgttctacttttatataaaggattacgaaatgtgatctataaatagtcagagtcggctttcttattcgagaggtcgattctgactatttttattttccggaagaataaagactactttccttttaataactctgtcgcttgatctccgaagacgatttttaatacttgctcttttttgtcgttgtctaacttgatttgtaagacagtttctgctgatatattattgtctctactcaagacgtatttttcaggatatgcaataatatctattactgattcttgcaaagcatttgcaatttgtaataatgtattatactttaactcccgttcaccggacatgataagactgaagccagcctgttttattccaatctgactggctagatattcttggaaataccctttattcctgcgaattgcgtctatatttcttaatatatcgttcatgtgggcaatttaacatttgtggtttgaataaataagcgatctctgtaataaaaaattgcacttttatttgctaatataacaaaatgcaatatctttgccgttgtgatattcttaattctcttaatagactgtttgttccctttttgaaacatttcgctattaagtctaattgttaaccaaatttatttgaatatgatattgatatataatgtgttgtgattatcggaaaaatagattttccgatattggaatgaacgggccaattatctttgattgtatagcttgttaaaattgttcttgtggtatctccgtaataaagattgcactttgttaagttatggggaagacaaaatctaagtttttataattcactactattcattttaatattgattgcctatgattatgaatttttaaatccaatgtttagaatcggatatgtaatagtatccattgtgttttttaaccttatattcatttaataacagacaaaaatgaaagaatctattttagatgtacatttagaaaaatgtcgtgctaaaagcaatttactcagaatgttaaccttattgctttttgcattatgtacgacgacagtatttgctcaacagaaaaatatcaggggaactgttatcgacgcctcaggtgatccccttattggtgtaaatgtttctgtaaaaggaactacgatcggtattataaccgatatggatggtaaatatcaactggaagtaccggctaatgctacacttgtcttttcttatatcggctaccagacgcaggagattgcggtaggtactcaatcatcgatcaatgtaacattaaaagaggacactcagaaactggacgaggttgtagtagtaggttatggagtacagaaaaaggtaacggttacaggtgctgtcgccagtgtatcgggggaggagctgaaagcgtctccgacgaccaacttgtcaaacggtatggtcggtcgtatgcctggggtcatcggctttcaaacagcagatgaaccgggcggtggtggaacaacaatccgtatacgtggtactaactctcttggtagtaatgatccgttagttgtaatcgatggtgtgcctgatcgtgatggaggtatgaaccgtttgaatccgactgaaatcgaatctatttcagttttgaaagatgccgctgccgctatttatggtgctcgtgctgctatggggtcgttttgattacgacaaagcgtggaaaggaaggtaagccggttgtttcattcaatgcaagtgccggtttctcgaaaccgactcgcttaccaaagatgacgaactcctatgaatatgctacaatgctgaatgaagtgcttccgggttctttctctgatgaacaaatcgaaggcttccgtacacacgctgatccatggaaatatccggatacagattggtttggtgaaattgttaaacctgcttctcctctgtatcgggctgatataggtgtatccggaggtacggataaagttaagtattatgtcaactttggagccaatggcgaagacggtctgtataaaaactccgctaaccgttatgaccagtatagcttgcgtacaaacctggatgttaaaaccagtcagtatgttgatttccagattggagctactgcccgtttggaagataccaaatatccggccaagggagccggtgatatcttcggtagtgcacgtcgtacccgcccggatcaaccggcctggtggccgacaggcgagcccggtccggctatcgaacgtggtgataatcctgccgtaacaagtacggatctggcaggtttcgaccattataaaaaccagtatatccagaacaacttggctgtaaatgtcaaagtaccttgggttgaaggcttgacgttacgtggtaatgcttcttatgatatccattttatgaatcgtagaaaaatgcaaaaaccggtttacctgtattcttgggacggagtgaacgaaagcagtgaaggattgaatgcttccaagcagtggatcgatgcaccgacattagagcgtaagcataccgagcaactgggttggatgctaaacggtttgatcgactacaatcgcacatttggacagcatactctcggtgtaacgttcggtatggaagggcaaaaaaaacaatatgaggagactttagcttatcgccagggttttatctctgatagtaaacctgaactgaatcttggcggtgaagaagggcaaatggcaaacggttactcctggaaagaaactcgtttgaactatttcggtcgtgtgtcttacaactatttggaacgttatttatttgagttcgtttggcgtgtcgacggttcttaccgtttccctaaagatgaacgttacggtttctttcctggagtatcgttggcatggcgtgcttctgaagagggatggtggaaggagaatattcgtttcatagactacttcaagttacgtggttctgtttcgcagaccggtaatgacgctcttgtggactcagatggtaattatgatcattctattcaatatttgacgacatatgcattcaacaatgccggtacgacatttgggggaattgagaataaacgtctatatccaagccgtactccaaacccgaatatcacatgggaggtaggaacaacttacaacgttgggctggatcttaaattcttgcagaatcgtttaagttgggaaacggatatcttctatcacaaacgtacaaatatgttgatatcacgtaatgcatccctgtcggaaatcactggtattactctacctcgtgaaaacttgggtgaaatgaagaatcgtggtttcgaatctttagtcagctggcaggataagatcggtcaggtagaatatggggttgctttgaatatgacttatgcaaaaaacaagatcactttctgggatgaagtacagaacgtgcctgaatatcagttctcgacgggtagacccgtaggtagtcgtaatttgctgtactatgtagcggatggcattttccgcaaccaggctgaaatagatgaggcgagggctaagggactattatactctgataatacagttccgggtgatattcgttttaaagatatgaacggggatggtaaaatcgacggtttggatcgtgttcgtccggacaagaaccaggagccgcgattcgtagccggtctgacgctgacggctaaatggaaaggttgggatgtgatgttgttgttccaaggggcaacaggtgctcaggtttatatcgaaacctggtctggtctggtcggaaactatctaaagagtgattacgaaaagcgttggacaccggagaatccgaactcggaaggtccgcgtgcatgggatcgtgaaaaccaatactggattaacaatgataatacatatttcctgagaaacgctgattatttgcgcctgaaaaatgctgaactcggttatactttccgtttcgaaggattgaagaaagcgggtatttcaaatttacgcctctatgcgaatggtagtaacttgtttactattgatggtgtaaaggacgccgacccggaacaacgtgatggtagtatcggtggctatcccttaagaaaaattatcaacttcggagttcaagcaacattttaaaacgtaattattatgaagacgaaactaaaatatatttgtctttcggcagtagccggactgacattttcactcacttcatgttcggactttatggaactgacaccggaagaccaatatgacgaaacagccgtttgggcggatgcggatttgactaaaagcgttgtgaatgatgtctactcgtatgtatgtgacatcgcacaagaagtgaatacttctgcctggtcggatgatgctttctttacgcatgtatatggatgtcgtgatataaacgaagctaccgtttcccccagtaatctggctgcttatgatcgtgatgactgtccattcaaatggagtaaacaatacaaaggtatctatcgggccaatctggtactggagaatatcgacaatgtgcctgaaaaaacaggtgtagacctaaatgttttgaaaggggaaacttattttctccgggcatatatttatacggagcttctccgtggcttcggtggggtacctattgtagataaggtgtactctatcgaagaagctgccgatctgagcttgtcgcgtgcgaatgtcgctgaggttatggattttatcctaaaggatatagagctggctgttagtttgcttccggaagaacaaaccggtgcaaacttggggcgtgcaacgaagggggctgccaaagctttaaaggctcgtgtattgttgcacgtcgccagcccgttgtttgcggaccgctctgtcaatacgttggaatgcaaccagtataaaggcgatcgccaagctttgtatcaacaggctctggatgcggcaaaagaagtgatcaataatggcacttattcgttgattgactgtaatgcaggtacaatcaaggaaattgcagacaatttccacaaaatcattatcacaaacaatgatgaaacgatctgggcaaaacagtatgtaaataaagatcagaatgctgacaactgggttcgcaaccgtgttgccttattacatggtccgaacggttaccacaactgggctggaactgctcctacacatgatttggtcatggcgtttgaaacagaagacggaacatttccaaacactttgctaaaagaaggagatgaaacgactgtaaatccgtatacaaaccgtgaacctcgtttttatgcgacaatcggttatgacggagcagaatgggggcgtcccagagctgccgatggtgctgtgtttgatgccactccgctgggtaatttgcagttcggttattatgaattaagtagcggtggttcaaaagtcgatgccatacaatctgtggatgacgagaatagtccgatcaaaacacagtcatttaacggaatggttggtgtagatacccgtatgtcgcagatagaaaactggaacggtacgtatacgggctatttggaaaagaaattgattgatggtactgtttctgcgactgaacataatttccagaccaatccgatgccgtatattcgtttggccgaaatgtacttggttgcagctgaagcctgcattgaactgaataagctggatgaagcgtctacttatctggatgcactccgtggacgtatcggacgtccggatacaaaggctactttatccgttcgtggacagactttcaatcagaacgacttacgtgagtttttacgtcgggaacgtcgtgtcgaactggcttatgaagaatcccgttattatgatgtgcgtcgttggatgatcgctccggaagcaggcagtaaaaaattgacaggtgtcactattgtaggccgtctgaaaccaggcaagactgcaacgttaccttatgtacacgatgaagacgtttataactatacctggactgttctcaatctgaactacatcgagaaacgtaaatgggataacaaaatgtattttgctcctatcaaattggaggagacattacgaaatccggcattggagcagaatccgggtttcaaataagggtatagaggtgtattgaattattatggcacgttgatcgcgcaggttctctgtggtatcagcgtgccatgtattatacaattgaataggtaaaggatgtgggggtatagctgtttatagatcaatatcaaatattaatattacgaaatttattgtacatattacagcattttgtaactttgggcaatctctcaattcgtaatttgtaaaatagtattatcatgaaaaacagaaagctaagaatgggtatggtaggtggtggaagcgatgcttttattggagctatccatcgtcgtgcggcctttatggacaatcagattgaattagtttgcggatgtttcagcgtagaccctgaaatttctaaaagttccggactctcttatttcctcccggaagatcgtatttacagtacttatcaggaaatgttcgaacacgaaatgactttgccggaaggcgaacggatggattttgttacgatcgtaacgcctaaccgctggcatttcgaaccggctatgatggctctggaaagaggcttccatgttgtggtggacaagccgatgaccttctcattggaagaagcgaagcaactacagaaaaaagtagaagaaaccgggctggtgctggctcttacccatgtgtattccgcttatcctgccgtgaaagaagcgaaagcccgtatcgccagaggtgacctgggtaaactacgccgtgtgtatgtggaatacctgcaaggatggctttccgaccggatcgaactgcagggggggaacaatgccggatggcgtacggaccctaaacgctcgggcaaagccggctgtatcggggatatcggtacacatgcctggcatttgagtgaatatataaccggtcttaaggtacaggaagtctgtgccgacctgaatgcttttgtgcccggacgtccgatcgatgatgatggtgccgctttcatgcgctatgagaacggggtagtaggtacgctgaccgcttcacaggttgcagccggagaagaaaataatatccgttccgtatctatggagacaaaggtggtctggagtggcagcaacaggaaccgaacaccttgtttgccaaatggaccgacaagccgaccgaagtgatccgaatgggaaacaacggatttataagcgatacggccaagatgaatacccgtacaccgggcggtcatccggaaggtttcatcgaagcatttgccaatatatacagaaacttcgcccatactgtaatgagtattaagaaaggagaacagccttgtgaagaatgcctggatttcccgactgtatacgatggcgtaagaggtatgcaattcattgaaacaatggtagaagccggttacaatgacaatcaaaaatggcagaagtgggtcgattgatcagacacatatattgaaaacctaatatcaaatgaaattaaaaatgctagcttgctgttgttccttaatcggaatgacagcattcgctcagaagaatgagtggaaggatccaaacgttaatgaggtaaaccgtgttccgatgcataccaattattttgcgtatgaaacagaggatgccgcgttgaagggatgcaaagaatcatcagggaattttatgaccttgaacggaacctggaaatttaactgggtacagaatgcagatgcccgtccgactgatttctaccaggtgaactttaacgacaaaggttgggcgaatatgcccgttccgggggtatgggaactgaacggtttcggtgatccgatctatgtaaatgtaggatatccatggagaaaccagtttaagaacaaccctcccgaagttcctgtagaaaataaccatgtcggttcataccggaaggaaataattattccggcagactggaaaggaaaagaaatcttcgctcacttcggttctgtgacctccaatatgtatctgtgggtgaacggacaatatgtaggatatagtgaagacagcaaactggaagccgaattcgatctgaccaaatacttgaaacccggaaagaacctgatcgcatttcaggtttttcgctggtgcgacgggacttacctggaagaccaggacttcctgcgtctgtcgggagtaggacgcgattgttatctatatacccgtaatccgaagtatatccaggatatccgtgtaactccggatctggatgcacagtataaagatgctacattgaatattgcattgaatctgaaaggtagcggcgttgtcgatgtgaaactgttggataaacaaggtaattcggttgcaacaactacactgaaagggtctggtaaagtttctgccgatatggctgttgccaatccgttgaagtggacggctgagacaccgaacctgtacactttggttgctacattaaaagatggtagtaaagaactggaaacaatacctgtaaaagtcggtttccgtaaaatcgaactgaaaggtggtcagatcctggtaaacggacaacctgtcttgtttaagggagcagaccgtcacgaaatggatccggacggcggttatgtggtatcacgcgaacgcatgttgcaggatatcaaaataatgaaagaatataatctgaatgccgttcgtacttgtcactatccggatgcaaacctgtggtatgacttgtgtgatgaatacggtatctatgtagtggctgaagccaatgtggaatctcacggtatgggatatggtgaagaaacactggctaagaatccgctgtatgccaaagcacatatggagcgtaaccagcgtaatgtacagcgtgggttcaaccatccggctatcatcttctggtcgttgggtaatgaagccggtttcggaccgaacttcgaagcttgttatacctggatcaagaacgaagacaagagccgtgccgttcagtacgaacaagcccgtacgaatgagtttacagatatctattgcccgatgtacctgggatatgacagatgcgaagaatattgcaaaggtaatatcgacaagccgcttatccaatgtgaatatgcacatgcgatgggtaactcgcaaggcggatttaaagagtattgggatcttgtacgcaagtatccgaaataccagggtggtttcatctgggacttcgtagatcagtcattgcgtatgaagaataaggatggcgtagagttttatggttatggcggtgacttcaaccgttatgatgcaacagacaacaacttcctcgataatggtttgatcagccctgatcgtaaaccgaatccacatatgcatgaagtaggccatatctatcagtcaatctgggttacaccttctgatctggccaacggcgtagtgaatgtgtataatgaaaacttcttccgtgatttgagcggttactatgcagaatgggaattgctggcaaacggtgaagttgtccagaccggaatgatcaaagacctggaagttgctccgcaacaaaccaagtcagtcaaattgaattacaatacagaaggtatttgtaaatgcaaggaattgctgttgaatgtagcgttcaaactgaaaaaggctgaaacaatgcttcccgccgggtatacagtagctaagaatcaattggtgatccgtccgtatgaagctcaggaattgaagctggctaatgttgaaaaggtaaatatcgcaacagttattcctgttatcaaagaaaacgattataattacctgatcgtttcaggcgaaaacttccgtatcgaattcaataaacacgacggtttcctttgtaaatatgatgtgaaaggacaagctatgatcgatgaaggcggcaaattgacaccgaatttctggcgtgctccgaccgacaacgacatgggtgccggtctgcagaataaatatgcagcctggaaacaacccggtctaaaactgacttctatgaccaataagattgaaaatggtcaggctgtcgtaaatgcggaatatacaatggaggcagtttctgccaaactgtatatcacctatacgatcaacaacgaaggtgcagtgaaggtttcgcagaagatggttgccgataagtctgcaaaagtatcggatatgttccgtttcggtatgcagatgcagatgccggaagagatggcacgcattaaatactacggacgcggcccgtgggaaaattattcggatcgtaataatgtaaccgacctgggtcagttctgtcagacagtggacgagcagttctattcttatatccgtccgcaggaaaccgggacaaagactgatattcgttggtggaaacaaacgaacaagggtggcaatggtttgatgtttgtagctgaggctccgttctctgcttctgcattgaattattcgatcgaatcgcttgacgacggtgtacagaaagaccagagacattcggaactggttcagaaggtagactatactaatttgtgtatcgataaggcgcagatgggattaggctgtgtgaatagctggggagcacttcctctggaaaaatatcgcctgccttatggagattatgagtttacttttattatgactccggttcagtcgaatttataaactgaaaattattaaaaaaagcataatcggcttacgattaacgttaaataggccggttgtgctttctttatattaaggaaaatactacttttattgccgatttttaaatctaattctcagactaagtgtaaaatattgaataccataaaaacagatggctactaacaaaaattctaaccgatattcatcagatccaaagaagtctttcttcagaggaaagacttttatgctccttcttggagtagtcttcggtgccggggttatgatcctggcctataatacttcagtctatttttcttccgacgaatcttgtatgatgtgccatgtgcacccgcatgtggagaatagctggaaactatccaaacatgtaaataacggaagtggagtgaaagtacattgtgtggactgtcacctcccgcctaaaaacgatacatggaaccattatacggcaaaagcgaaactgggcttgaaagatgtctggtcttttatgacgaaagacagtgccgatttcgactggaatgcaaagtctgaactggagcatgccgtaaaatatatccctaacgaatcatgtaaagagtgtcaccagaatctattccccgaagggattacgaacgatggtatcacagcgcatctttattatgatgagaatgaaaagaaactggacttgcaatgtatcagctgccacctggatgcgggacactataacccgaactataaccattcgaagatggcgggtgtaccgggtatggcttccggtgccggtgtaatcgatacaagtctctattttaaagaaccggcagcggtaacagcctttgccgatttcaaggaacagatccccggcactccggtgtcgtttaatatggtggctgtccccggcggaacattcaagatgggtagtaccccgaaagaaccgttccacaaaccggatgaagctcctgtacgtgaggtaactgtcagcccgttctttatggctgaactggaagtaacctgggatcagtactgggcattctacggtagcacgatgagtgaagggcgtacacctcccgaaactgtatatgcaaacaacagtaacccggatgtagatgctatttccggtccgactcctccgttcggtttcccggatcagggatggggtggcggcgatcgtccggctatcacgatgacacattatgcagctgaaacattctgccagtggttgtcaaagaagacaggcaagaaataccgcctgccgaccgaagccgaatgggaatatgcagcccgtggcggtacggaaactccttacttcttctccggtagcccgaaagatttctcggatcagggtttctggcgtaagttcttcgatgcaaagaccgacagcatcagttcgttcgttatttacggtaagaacagtaagaataagacacaagaaccggatctggtgaaagccaatccgttcggattaaagaatatgttgggtaatgtcatggaatattgtgcagacaagtacgatcccgaagcttacagcaagggaggtaacgctgtaacaaatccgttggtgactgaaggaacagaatgggttgtacgcggaggtaattatacttcggacgctgcagatgttcgttcggcagcccgcgactataccaaacatgatgcgtggttgaagacagacccgcagcaacctaagagtatctggtggtactcagatatacgcggtattggtttccgtgtagtatgtgagccggatgcctcaattaagtagtagactagtgtaaaaattatatcaattctttaaatttgctatatcatgaaaaaggaaaactgtatcagtagaagatcgtttttaaaaagctcggctatggctggtgcactgggtgcaatcggtacaggtagtgcggctagtgttttaacatcttgtgacggtggaagcaaagcgaatgctttgaagccgttgaaagaacccggaacatattacatacccgaattgcctgacctggcaacagatggacaggaactgaaagccggtgttatcggttgtggcggacgcggttccggtgcagctttcaacttcctgaatgccgctaatggtgtaacaatcgttgcattgggtgacactttccaggaaagagtagatgatctggctggaaagctgaaaaaagataagaatatcgacataccggccgacaagcgcttcgtaggtctggatgcttataagcaagtaatagacagtggagtagatgtagttattattgcaactcctcctgtattccgtccggtacatttccaatatgcaacagaaaaaggaaaacattcattccttgaaaaaccgatctgtgtagacccggtaggttatcgtacgataatggctacagctaaacaggctgatgctaagaacttacgcgtgatcacaggtacacaacgccatcaccagcgtccttatgtagaatcttataagaagattatggaaggcatgatcggtgagattacaggcggtaccgtttactggaaccagagtatgttgtggttccgtgaacgtcagaaagaatggaacgattgcgaatatatgatcaaggactgggtgaactggaaatggttatccggtgaccatatcgttgaacagcatgtacataatatcgacgtattcacttggttcagtggtctgaaaccggtaaaagcagtaggtttcggttctcgtcatcgtcgtgttacaggtgaccagtatgataacttcagtatcgacttcactatggagaacggtatccatatgcatagtatgtgtcgtcagattgacggttgcgtaagcaatgtaagtgaatttatccagggaacaaaaggttcatgggatagctctactatggagatcaaagatcttgccggtaatgtagtatggaaatacgattatgaagcagagaaagcgaacttcaaacagactgacccgtatacattggaacatgtgaactggatcaacagtatccgtggtaacaaaccgcttcagcaggcatccgaaacagccgttgccaatatggctgccatcatgggacgcgaatcggcttataccggtgctgaaacaacctgggatgcaatgactgcttctccgctggattatactccgaaagacctgaatctgggtaagatggatatgagtacgtttactgttccggttccgggtaaacctcttgaacaaaagaaataagatatgactctgaatagaagaaactttttaagaacaacattgtccggtgccgcagtagctgctgtaagcaccggtgcattggcctcctgtgccggcaaggcttcttctccggaaacatgtccggaaactaaatcctgctgcaacagtaaggcgaagttgaacctttctttccaggaagggactcctccgggtgaaagcctgaacgagaagttcgattacatggagaagatgggtatcgtcggttttgagccgggcggacgcgggttgaaagaccgtgtgggtgagatcaaacaagccctgaacggacgtaacatcaaagtcagtgccatctgtgcaggcttcgaaggttttatcctctctaccgatccggctatccgtaagcaatgtatggatacgatgaaagagatcatcacggcagccggtgagctgggttcgacgggtgttatcatcgttccggcgttcaacggacaggtgccggcacttcctcataaccaggaaacccgcgacttcctttgcgaacagttcaatgaaatgggtaaccatgcggctcagaacggaaccaccgttatttttgaaccattgaaccgcaaagaatgtttctatatgcgtcaggtagccgatgcggcttccgtatgcagggatatcaacaatccgggcgttcgttgcatgggcgacttctggcatatgacctgggaagaaacttccgatatgggagcgttcctctcggcgggtgactatctgcaacacgtacacgtggcaagccgtaaacgacgcagcatgccgggtgaggatggtgatgcagataactatgtgaatggcttcaaaggcctgaagatgttgggttatgataaatatgtaagtttcgaatgcggatgtcagggtgatcgtaacacggttcttcctgccgcagtggaattattacgcaaacaatgggaagaagcataaattatgcctttagtatatcctaatatgcaaatgagcgaggtggtggaggaacatccctcgctcattcctgtaatcaaccggtttggtatccgtcttggattaggcgacaaatcggtgaaagagatctgtgacgaatatcagttggataccgactttctactgatagtgatcaacacgttcctgaatgaagagtactttccggaaaggaaactgcaaacattccatacttcgcagatcatcgattacctgaccaagaccaaccagtattatttacgttatcaactgccgaatatagagcggcatcttacctcttttatctctatgagtacaccgggcaacaatacgttgaacctgatcggcaagttcttctcttcttttaaggaggagttgacatcacgcatagagaaagacgatcagctatggtttccctattgcctgtctttaagtgaaaagattaacggctgccaggcctcggacggagccgaagtgcttcagctcggtggcgagcaacggttggaagatcctattgaagccctgctttccgacctgaaaggtatcatggttaaacatctttcgggcgattataacgagaatttatgttatgccgtgatcttcgggatcagcagtctcgcgaaagatatcaagcagcacaaccgcatccgttaccgtattcttactccgatggtttccgcgatggagaaactttgtaaataacccttgttgatgcatagaaccaggcaaatagcgatcattttatccgatactttgcagagcattggccttcagagcttgcttaccgactatttccctcctgtggaagtgtgttggtttcctacgttcgatgctttcaatgttgacggttgtaacgatacgttcgattattattttacctcacctgagacacaggtcatgaacggtgattttttccttccccgccgtagtaagacggtggtgttaatcaatgggggagaaggcgacggtggtatctctacaacgaatcatatcacgataaaagcttcccaggagattatcatcgagcagttgcagcaattgctggccaacgataattccggtaatttatccggggatacgaacaaagacctttccacccgtgaaaccgatgtccttcaattgatcgtaaaaggtatcaccaacaaagagattgccgataaactgagcatcagtctgaacactgttctgacccaccgcaaaaatattaccgccaaactaggcattaaaaccgtctccggccttaccttctacgctatcatgaacgggattatttcgggtgatgatatagaattgtagaaatagcatgttaaaatcactacatgtagtgattgatggccttgtatctttcctgttcctttgcaatcagaaaatactaatagttcgaatacgatgaaacaatgctacctgtatgtcctggctgcaagctctttattcggtttgcaatcgttgaaagccgatgaggtgaatgtaaacaaaaatgatactattaagacatataacatcgatgaagttatcataacttcttcgacaaaggagacgaatgacttgcgtttgttgcccggttccgtgtctatcctctccccgcaagcaatttccggacgccagatcgatgcgttgaaagatatcagttcctttgtccctaacctgtatatgccggactatggttccaagatgacttcggccatttatattcgtggtatcggtgcacgaagcagcgggcagtcgatcgggctatatgtagataatgtaccgtatctcgataagagcacatttgatttcgaactgaatgatatccagcgtatcgaagtgttacgtggtccgcaggggacgttgtacggccgtaatgcgatgggaggtatcgtgaatatttataccctgtcacctttcaattaccagggaacgaaactgtccttatccggtggaaattatggtgcgttcaaggcaaagggagcacattaccggaagttgagcgataatgtaggtatttcccttagtggctattacgatcggaacgacggatttttcgtcaatgaactgaagaacacacgggcggataaggaagagtcggcaggcggacgtttcaaactggactggctgatcactccgaacctgaaggcgcaatatacattcaactacgattatgtcaatcaacgggctttcccgtacggactttacaataaggagacgggagtcgtagaaccgatccgtatcaacgaccctagttcttatgagcgtaatatgttgaacaatagcctttacctggaatggaaaaccgataagttcctgctttcttcgaccactgcttaccagtatctgaaggatgacatgaaaatggaccaggactataccgaaaagtctatcttcaccctcaaccagaaacagaaacaatatgcctggagcgaagaagtggcgatccgttcgaacgataagaagaattaccagtggattttcggggcttacggcttttacaatagcctgaagacggatgggccggtgatgtttaagaaggatggtataaaagaggttctacaggcagctttcgacaagattccttttccaaagtttaccgttaaaggagaaaatgatcagatatattttcccggctattttgaaacgcctacttatggtttggccctgtttcaccaatcgacatataatgatttgtttattcccggactatccctgacggccggtctgcgtctggattatgaaaaggcgaagatgaattatgattcatcggtggaaggcatgacgattaatatgtttttacccagtatggctccgggtatgccgaccattaatcaggactttcctgtaacttcccgcctgacgggagaagagtcacaggattttctgcaactactacctaaagcatccctgcgttatcagtgttcaccgggaacatttacttatatctctgttgccaaaggatataaaacgggaggatataatgtgcagatgtttggtgatttggtgcaggctcaggcacagtacgacttgaaggaagaaataaaacagataatgccgccgggaatgggagggatgtttgaaaatccggaattgccgcctgtatccgatgttgcttcttacaaaccggagcatagctggaattatgagatcggtgttcgtagtgaattgcttaaagatcgtttgaatatggaactgacgttattttatatggatattagcgatctgcagttgactacatttgccacgaatggtagcggtcgtatgataacaaacggaggcaaagccgatagttatggtgtggaggtcagtctccgcagccttatcacaacaggtctgaccgccgacttgaattatggctttacccgtgccactttccgtgattatgctaccttggataagaacgaggaggagacgaactataaaaataattttatcccgtataccccgcgtcataccgtcagcctgggattgcaatacaccaagttgctacgtaattgctggctcgaccagttcactgtctccgcccagtacaccggagccggtaagattttctggacggaagagaatgatatcagccagagcttttatggtgtgttgaacggcaaagcaggtgttcgcaaaggttccgttaacctcaacgtctggagtcgtaacatcacgaatacggattatcaggctttctatttcgaatcattcaataactcattcatacaaaaaggcaaaccgttccagataggagcggaggttgctgtaacattttaaatttatcagttttgaatgtttcattatttgacagatttgaatgtagtgcgttggtaggggcggttcgcgaaccgcccttacaggcgccgtcacaatggaacaggcaggttcggccgtaggggcggggtctgcccgcccttcttcaccggttgttatattattgtcgcaaagggtgggcaaaccccacccctacaaaacctgtcattttggttcacctttttttataaataaattatatgaaaatagtactcttatcttgttgtttcttcctctccgtattatctgttaaggcggaagaccgggataccgtaaaagttcgtcaggtcgatctgaacgaggtggtcgtacaatcattcaagcagaacagggatctgcggttggagccattatcggcttcgtccgtaacagggacagcgatacaaaataaaaatatcaccgatatcaaggaattcagttcctttatcccgaacctgtttatgccggattatggttcgaagctgacttcacccgtttatatccgtgggatcggttcgaagatcaatgccccttcggtcggtctttacgtggatggcatcccttatttcgagaagtccgctttcgatttcaatttcaccgagatcgaccggatggaagtattgcgtggcccgcaggggaccctgtacggacgtaacacgatgggagggattatcaatgtatataccaaatcgccattgaaatatcagggaacgaacgcctttatctctaacggtacttatggtaatcgcgattatgccctttcccggtatgcaaagatcggggaaactttcggttatgccctttccgccaattataaccggagtgacggatatttcaccaacctgtataccgataagaaagctgacgatcagaaaaccggttcaggacgtatccgtctcgaatggaaaccgacagaccgattgtcgctgggcctgatgagttcgtatgattattccaaacagggtggctatccttacgccgtttgcgactccctgacgcatcggccgggcgatgtcgattataacgattatagtttttataaacgggccatgtctactaccgggctgacggtcgagtatcggggaacaggttacagcctgagcagtaaaaccgctttccaatatctctcggatcaccaggggatcgaccaggatttttctgtacagagcatctattttgccaggcaggatcagaaacagaagatgctgtcggaagaatttaatatcaaatcgacaacggccggccgttataagtggctgttcggtgctttcggtttctggcaggggatcgataatacggtgacgctggattatctgtctgcccaatacagtacgcggaaattatatgatactcccacttacggttttgccctttatcaccagtctacgttggatagcctgctggtggacggtctgtccctgaccctcggggtccgatacgattacgaacgggcttctaccgattatctggcttttaaagatgccggcggtagcagtagccggacagatgatttttacagtaaactgaaatttagccaggtgacgcccaagattgctttgcaatatatgtttccctctaccggtctgttgtatgctaccgtgacgaaggggtacaagactggtggctttaatacctctttcgaacgtgaggaagaccgctctttcaatcccgaaagtagctggaactatgagttgggagggaaacacccttttctcgataaccggttgcgtgccgagatcgcccttttctggatcgactggaagaatcagcagatcagccagacgcttccttccggcaggggatcgatgttgacgaatgccggacgcagcgttagtaaaggcgtggaagtcactttacagggaaacccggtgaacggcctgatggtgcaggtgaattatggctttactcatgccacatttaaggaatatgtcgatgaaaagaaaaatatcgattactccggcaatcggctgccgatggttccttcgcatacctttgccgtcggagccgactacacgatatcgaatccatgctcccatatcgaccgtttcctcgtcagtctgaactataccgggacgggccggatctattggaaggaagacaataaagtttctcagtcttattacggacaattgaacggaaaagtttctgcaaccaaaggatttgctacctttgcaatctgggctaaaaacataacggatacccaatataacgctttctattttgaatcgggagggaaaggcctggcacaacggggccggccattcacgatcggaggaagtgtggcgatttcactttagcttgcctgacggaaaagtatcgctctcggtggtagccgaaagcctgcctgacagaaaagtattgctctcggtggtagccgaaagcctgcctgacagaaaagtatcgctctcggtggtagccgaaagcctgcctgacggaaaagtatcgctctcggtggtagccgaaagcctgcctgacggaaaagtattgctctcggtggtagccgaaagcttgcctgacggaaaagtactgctctcggtggtagccgacaatgatatataaagaaaaacatgaaacaagaaaacaaaatattcaatctcggaacctttttttgtctgtacatcgcacagacgataccgatgagctttttttccaccgtcatcccggtcatgatgcggcaggagaacttctctttatcagccataggattactgcaactgatcaagctgccctggatactgaaattcctctggtcgccgatggtagaccgtcatgcccggacgacgggcgactataagcgttggatattctcttccgaacttatttatgccgtactgatctttgcggttgctttccttgatttcaaaacagatttttataccatcataggcttaatcatcgtctcgttcattgcttctgccacgcaggatatagcgaccgatgccctggccgttctctcgttcagccggaaagataaaagcctggcgaacagtatgcagtcgatgggcagcttcggtggttcgctgatcggtggcggggtgctgctgttgttgtttaaacagttgggatggaacagtctcctgccttgcgtggctttatttgttatagtggctctgctccccttgttttttaataaaggaattgttattcagccgaaagatacccacgaacgggcaaagaaagccgatgtcttctactttttcactcaaaagaaaatatggaaacagatcggtttcctgttcctctattattcgggattgatcgggacactggcaatgttgaagccttacctggtcgacctgggctattcgatgaaagagattggcgtaatgagcggggtggtggggactgcctgcggcttcctgtcttcctttgccggaggctttatcgtccgccgcatcggacggcatcgcggacggctgttgttctccctctttgtcttgctggcgacgctctattttctggctctctcttatacgacaccgacaaccgaacttttgtatgccggtatagccctgctttggggaagctatgggatggctaccattgtggtatatactaccgctatggattgcgtacgccccggacgggaaggaacggattttacgatacagactgtgattacgcatttgagcggaatgctgatggccatactgagcgggaagatagccgatcataccggctatcacggattgtttttctttgaggccggcctcgccctcttgtcgcttgtgtatatattgatcgtgttcggaaaagagaaagaaacagcatagttatgatacaaaacttattacagaaatacaatgtgccggttccgaggtataccagttatccgccggccaattattttacggatacatttacaaatgcagattatgaaactgccatagaagcctctaatgccgcaggtcccggacatatctctttctatgtacatattcctttctgccgtcatctttgtcattattgcggatgtaattcgtttgcgatgatgaaccggaatgtggtggaacgttatatagaagccgtacatgtggagatcgatagagtgaaagagcagctggctccgggacgaaaaatatcccagatacattatggcggaggaagccctacagccatgccggtatatattttaaaagaactgaacgaacatctgttagccggttttgaaacgatcgatcagccggaaatagccgtggaatgccatcccggatacctggatgaagaatattggcagtacctgaccgaagccggttttaaccgctttagcctgggtgttcaggatttcaatgaaaaggtattgaagacggtaaaccgtcgtccctccttactgccggtcgaaatgatcttccggatccttcgcagcaaaggagcacgtatcaatatggattttatttacggattgcctttccagacagccgagagcttttccgagaccattacccgggcagccgttttacgaccggaccgtttggttactttttcttatgcgcatgtcccctgggtcaaccggcaacagttgatcctggaaaaagccggccttcccgccagtgaggaaaagagtcgtatgtttgaagctgcgaaagaaatattgggcgatgccggttataaaaccatcggtctggatcatttcgttttaaaagacgacgaactctataccgcccggcaaaacggacagctgcaccgtaacttccaaggctattgtacccgtcgtaccacaggacaggtgtatgctttcggtgtgacgggcataagccagctgagttccgcttatacacagaacagtaaagatattcaccaatatatcgaacagatcgaggggggggcgtttgccatagccaaaggatatacattaagccgcgacgaacagatcacccgtgaagtgatcgaaacgctgatgtgtaactataccttgaattggcaggatgtggctacccgcctgtcttgccccgtagatgaggtaaaagcagcaactgcttatgatgaaaaacgtatgcgggagtttgccgcagacggcctggtcgaatacgacgatgaccatatccgcatgacttccgaaggtgctctttttgttcgtaacgtggctgcatcgctggataagctgatgcttcattctaataaatcattttctaaaccagtctgatatggaacagcatactacggatattctgataatcggagccgggctaaccggtctgactaccgcttttcatctggtacgtggaggaaaacaagtgcatatactggaatgtagcgaccgtgttggagggcagatccatacctttcgtgaagagggttttatctttgagagcggaccgaataccggtgtagtttcttatcccgaagtagcggaactgttcatggctttatctcccgactgcaagctggaaactgctcacgaagaggcgaagcgccgtctgatctggaaaggaaactcattccgtgaactcccttcgggtctattcagtgcggttaccactcctttgtttaccctcggcgataagttccgtatcctgggagaaccttttcgcgcaaaaggtacgaaccctgacgaatcggtaggagagttggccgcccggcggttaggcaagtcattcttgaattatgccgtcgacccgttcctctccggagtgtatgccggtaatccgatgaccctgatcacccgttatgccttgcccaagctctataacctggagcagcaatacggcggtttcattaaaggaactatcgcgaaagcccgtcaaccgaagacggaccgtgaccgcctggcctccaagaaagtcttttccgctgccggagggttggataacctgacccggacgatggccgtagctatcggtgaaaagaatatcaccctgtcggcttccggcataaccatctgcccggcagaaaagggctggctggccagctatacgactcaggaaggtaagcaaaccatcctggctgataaggtcgtaacgaccaccggtgcctatgcgttgccggagcttcttccttttattccggaagaagaaatgagtaagataagtaatttgaaatacgcaccggtggtacaggtcagtgtcggtgtgcgtaataccggaaaacttcgtttcaatgcttttggaggactggttccttcctgcgagaaaaaagatgttttgggtatccttttcccggctgcctgcttcgataaccgtgccccgaaagaaggcgctctcttttctttctttatcggaggagtgaagcatgcggaactgacccgtctggaggatgacgaattgaaggcattgatcactcacgaatttcatgctatgctgaaattcccggccgatgtgcaaccggatatgatccgtattttccgccatccccgtgccatccctcagtatgagttgagtagcggcgaacgttttgccacgatcgacaggctcgaagcgcggtatccgggattgatcctggccggcaatataaaaggtggcatcggtatggccgatcgtatccggcaggcaacaggtatcgcggaaaacttgctcatgtaagtcaaaatcacttcctttgcagaaaagacaagcttatggataataaggataagatggtagaaatagcccggtttcaatatccggcagaggctcagacattgatggcattactcaagtcggaaggtgtcgggtgttatcttcgtaatgaatatagcagtcaggtaatggctggctacgtagacgtcggtggtgcccgtgtggagatactggagagcgatgtccctcaggccttggaaataatgaaagaaggaggttatgatatcccggccgaagaagagcagcccgagcagatccgtgtggttgtaggctggactcgtcatatcccttttttgcgaaaccttgcgtttgaaaagcaaattgtcatcttatttctgattatagctgtgtttttggcattattaatcttttttggatcagaatactcttccaactaaacaaatgtaataaatggcgcgtagaaagataacaaatagtcaggcggtatgtcttactttattatggggcgttttggcctacatgctgcttacatacagtgaaaagataacctttgatgtgatatttgccctggttgcatcagctatcattgtgttcgttcctgtctataagaacataaagcgtaggaatgaatagcatttagtcacatttgtcttcttaaaatatcgaaatgatatttttttatcattttttctttcaaatatttgctggtatgaaaaaatggcttacctttgcgacgttgttaaaagaacagcgtaaaatagcaaagtggtataacattctaaataaacagttctatgaaggcaaatgaagttttagacaacttaaaaagaagatttcctaacgaacccgagtatcatcaagcagttgccgaagttttaggcactatcgaagaagcttataacgaacatcctgaattcgaaaaaagcaacctgatcgaacgtctttgtatccccgatcgtattttctctttccgtgtaacatggacagacgataaaggacaggtacagacaaatatgggttatcgtatccagcataataacacgatcggtccgtacaaaggcggtatccgtttccatgcttcggtaaatcaatctatccttaagttcttagctttcgaacaaactttcaagaactcactgacgacacttccgatgggtggtggtaaaggtggtgccgacttcagcccgcgtggtaagtcaaatgctgaaatcatgcgtttctgccaggcattcatgatggaattgtggcgtcatatcggtcctgacactgatgtgcctgccggtgatatcggtgtgggtggtcgtgaagtcgcttatatgtacggtatgtataagaagctggctcgtgagaatacaggcacactgacaggtaaaggtattgagttcggtggttcgttgatccgtccggaagcaaccggttacggtaacgtttacttcctgctggaaatgctgaagactcgtaatatcgacatcaaaggtaaagtggtagctgtgtccggttcaggtaatgtagctcagtatacagttgaaaaactgatcgaactgggagctaagccggttacaatgtcagactctgacggttacatctatgatccggaaggtatcgaccgtgaaaaactggattatatcatggagctgaagaatctgtaccgcggacgtattcgtgaatatgcagaaaaatatggctgcaaatatgtacagggtgctcgtccctggggtgaaaaatgcgatatcgctatgccgagtgcaacccagaatgaattaacgggagacgatgccaagacattgttagctaacggttgcttcgccgtttctgaaggagcaaacatgccttctactccggatgctatcgatgccttcctggaagctaagatactgtatgctccgggtaaagccgctaacgccggtggtgtttctgtatcaggtctggaaatgactcagaatgcaatgaaactgagctggacaagagaagaagtagacgaaaagctgaaaggtatcatgaaatctatccacgaacaatgtgtaaaatacggttctgaggatggttatatcaactacgtgaaaggtgcaaacgtagcaggtttcatgaaagttgcaaaaggaatgatggcacagggtatcctgtaaattataaataaggagttgtttgccaaataaacattctgtagttatttggtcatgtaaaaaagggaaccggaaggttcccttttttagttatcggttgtaaacgagagtgatttttttattctacgtataagactaatcctttcagatattccccttccggatggtaaatgttaaccggatgatcggccggctgcgtcaattgatgcaggatacgtacgctacgtcctgattgtgcggcagcactgaacactgccaggcggaaattctctttgctgaccacctgtgagcaagagaaggtaaacaggatacctcccggtttgatcttttcaaaagcgatcgcattcagtttgcgatatccttgcaaagcgttgcgtaatacattcttatgtttggcaaatgcaggaggatcgagaatgataaggtcgtaattgcttcccatcttttccaggtatttgaaggcatcttcagcaaatgctttatgacgcgaatctcccgggaaattcagttccacatttttattcgtcagcgaaatcgctttggctgaactatctaccgagtgaaccacttcggcaccgccacgcatggcatagaaagaaaaaccacccgtatagcaaaacatatttaataccgaatgacctttcgcatacttttccagtaacgaacgattctcacgctggtctacaaagaaacctgtcttttgtcctttttgccagtctacgcagaatttcaagccgttctctgtggcaatatcttctacctctccaccatataaatagccatcttcactcccgaggttggctttgtagggaagagttgcttccgatttgtaataaatattctgtaaagtgtctcccaagacagtctttaatgcttcggctacatcatgacgggcataatgcataccaaccgagtgagcctgcataacagccgtatgagaatagatatcgatcaccagaccgggaagattatccccttcaccatgaatcagacgatatgtatcattgttttctacttctgccagatccagctccttgcggagagtgtaagcaacgcgtatacgttcttcccagaattttgcgtcgatagtgaccggcttgaacgataaaatgcgtacggcaatactaccgatctgatagtggccgatagccaggaaacgctggtttgttccgtacacttctaccaggtcgccctcttccgggttaccttcaatgctttggatagctccggagaacacccacggatggaagcgcagcaacgattcttcctttttaggtttgagaaagactttacaatagttcattattatttatcttgattcaattggttgtatatcttcaggcaggcccaggcgtcgagggctgcatatttcttctgttgttcggtcagtacatcggcttcccagttactcaggcgctggcctttcgatattttcttgtcgaaaaggatagcatatatcttttgcaggctggcatcttcgataccgaactgtccgacataattttgcagatccagaaagttcgccggcttgatatctgtccgtttccgtatggcgccgaagtcgtcgcgcagggaaaggccgatctttaatattttgtcgtttaccatgaaatcttcgagcggttgaggaataccgattctgttcagacggaacaggaaacaagcttcgtctgttgatatctgcatcaacgagattttataacgcgtaccttttttaaagctgggacgtgtctccgtatcgaaaccgacagcctcaaattgtaacaggtattcaaccgctttatctgcatctttttcggtgtcgataacgataatcctaccgggaaattcttctatttcaagaagtgatatttcttcttttgatattgtgtgtgtatattgtgtcatcattcctcgttcgtttctataatttcatcatcactgtaacgggcagcatgaagagctttcagtgcattcaggagttgctgtccccagaactcccggaagttggtacggcataaggcgatagcctgaagcatcacttcttcgtatccctgacggaaaagagaaacgaaattaccgacatcctgataaacatccgccaggttttccgagataaatgcagcgataggcgtgtcactgtactgcatatccggatggaaagtttccagataggtgtctttttctcccaacaggcttgcgatccgggtacgaacagattcgtacatgtcttctgttacgaacaattccgattcggcatcttcatcagattccacttccggcaaaagcgttgccttcagataaagcaagggcaatatctttacagctttgtccataaaatcaaaaaggccgttttgtccggctgcttcaacaaatgtgcaaaactctagcgctacagttacaaactccagcgtattacgttcgtatatgggattattttccttttccattttacttcttatggtgttcctaccatttctaacctgcaaaagtaagaaatatattgcgataatcagaattattaattcttattaaggtctaatggtgaaaagtcggtcggcaattagatgagtttcatgtatagtgtaaacagttaagaacagaagtgaatttgaaaaaataaaaattgccagatgctataaaaaataagtattcaagagaataatttccttcattctttcgtatctttgaacggaaagacttcaatggcttataattatcggccgtatggctgatagttgtgagccgtatggtcgataattatgagccatacggcggacggttatcaaccgttgattagtcgcggtagtaattcaaattagtatggcatgtaagaagcaatagtacgtaacctaataaataatatcatggctataaaatttaaagtttattcaacacctaaaccgaatggtcggaaaggaagtaaattatcccatgcgcgtgcaatcagccagggcacatataatctggagaaagtatgcaggctgataagcgaacgctcggctgtctcatcagcggaagtgaaaagcgttctggattcgtttgcctgggtgatcgagttggctctggaagatggctgtcatgtcgagttggatgatttgggatatttctctccatcattgagaactgttccgaataagaaaaaaaccgataataatacggtttatgtagacgggatcaactatcgctgttccacttctttgcgtgaaaaattacggcaaatcgatttggtatatgtgaaagacaaaaagaagccggatagttgggaagaacgtaaaaagaaactgttgagtcatattgctacctgggacagtatcagtcctcgcagctatgcagaagctatcggttgctcccgataccgggctgaggccgatctgaaaaaatttgtggaggaaggggtgttagtcagagtaggataccggaataaggtgatgtatttgctggcgaacgatgaagggaagggataaattactgtatttgccattattatgtggggaaatgtgttttattatcacatttcaatatcttaggttgattggacttataagtttttgggattgacaaatatggttgaaaggtaaaatcttattgaaaaataatggctgtatgtattgtttgagtaattttctttgtgtaattttacgattagagagaatgccggaaaaacaaagggacaacgcaaataatatatacagttatgaaaatatatatactacctatcttattcattcagatcctattgtgtctttcctgtgggtctggaaaaaacgaaatgatattttctgaatcagaatctcttttagaaactgatcctgatagtgctttgtatatattgggctctattctttacccagaggaattgaacgcagaagaatataatcgatatgtcctattaaaaattcaggctgaatataaatcgtatcaggatatcacatccgattcgactattctttccgtacgggattattatttggaaaagaacgataatcctaatatcgctttggcattatattattgtggttgttattacaaggagtgtggaaacggcgaaaatgcaatgagatgttttctggaagctgatgggtatgcggaaaaaggcggtaatataaatttgaggggactgattcggaacgctattggagttcttttattaaatcagtttgatagtgagggagcaatattaagttttcgaaagtcagcgtctttttataaacaggttggaaatttgaaaagtgaacttattacttatattcaaataggtgattgttttcagtatttggaacaaccagatagtgctcttgtttattatattgaatgtttgcacttagttgatagagaaaaattttgccaggagaaatctatcgttcgacagaacttaggtgtattatatgcccagaaaggagaattaacaaaagctattcaatttttgaaagaagcattggaatacacatccaatcaagataatcaaataaaaatatatgtgtctttgttagatttgtatactgcaagtcatcaaggagattcggcaaatgtctatatgagctatttgttgcaaaggaaagatagcataaaggatgtatatgtaaaggctaatttatttcagcttctttcagagagagaggaactccttaaaaattacccggaggctttgacatattataaaatgtatgctgagaatcttttgcagataattgatgtcaatcaggataaaagattgttggaacttcagaaaaaatacgattatgaaaaggttcgattacataatattcgtttaaaactggaaagagcaaatatctttatcggtttaatattaggaatattgttttttattatttcgatattcttattattcagaagatataaaaaacataaaaatgagatattagaattagaagaaaaaataacgcatttgaatattttatcccaaaaatatgatgaaaaggaacaaacattcacttcctatttacttaaacattttaatgttttaaagaaaatgtccagtttaaagatttatatgaataaagatatatctcataaagatgaattttggataaaaaaaataaatgagataatctatggtcaggatgctttgaactgggatgttttatatgatgtaatgaataaattgcataatgatttttttatccggttaaaagaattatatcctcaattgaaagaaatagaatatcgtattctttgtttgacctattccggtttttcaacagtggaaatatcaattgtattaaatttgagtgtaaatacaataaatatgaagcgttctgctatacgtaaaagtttagatattgtagcttttactaatttacgtgacttcttaaatgaaaaattgaattgatgaaccttttcttatcattgaaaagttatattgtgtatttgttatatggttgattattagcttgttgtttttgattgtgttctgtaaaaagttatatacgtgtagtgtgatagcgaatagtaactaaatttgttcccaaattaacataataaagaataaatatatgaatcagactaaaacactattcggaacattaatagtagcaggctttttttttgtgccttgtgtacaaactaatgtatttgcctctggtaataaagaattatgtacagtggcgagttcttcaaaagtatatttgaaaggacgtttgtctactccgacaacgcgaagtagttctcaatcaattgaagtttttcaggaagataatgctttgatggtttattatttagatgtattagaagaagtagaaattacaattattgacgaccaaaatatgattatttattcagaagtaatatctgtcttcaaaagttctaaatcattaatagaactgagtgaatcactaaatggtagttatactattaaatttaaagattcaaaggggggagaattaacaggaatatttactatagaatgaaaaaaataaataaactatattgatatgaaaaagaagatttacctattaaccgttttaattacttgtttgtgttttacttcaaatgctcagttgcgattactacaaaatggccgtgtccaggtggggacgcttagaacagatccgacggaagatcctctgaatgtaacaactatgcaggtatttggtccttatggcgatatgcgttctggttcgaaattgacgttcggcgattttggacaatatccaaatcaaggttggaatgtttttattggagaatatggatcggatgatacggatcagctttggttacatgggaaaagggggatctatttaactacaagtggccaagcaaataatattgtagcatattacgctccggcatcgaatagtaattttatttttaatacgaatcttcgggtaaatggtgtaaatataacttcagatgctcggttgaaagagaatgttcagacactgcaaaatccattaaatattgtaagtcagctaaatggagttagctataattataaactttctgaaattaataaatatcgcgaacaggatgcctcaaaatttaccgaagctcaaaatatgcagaatagtgcaagtgtttcttctaatgcagccttgacaggtaaagagaatgatgacaaactttatcaaaatgctgttgatagaaaagaagcggaagatgccagtcgcaagagaatcggtttcctggcacaagatatagagaaggttttaccggaactggtacagacagatgaaaatggagtcaagtcgattgattatatcggttttatacctctgattgtagaaagtctcaaagaaatgcaacagactattcaggcacagcagaacgaaatagatcttttgcagagccttttgccagaggaaagtaagtcgctattgcgttcaacttctacagataatatcgttatagaaggtgcaaaattatataacagagctggtacctcagtttcttatacattaccttctacttttgccaatgcatatttgcaggtgtttgacattgcaggaaggatgttgaagaaaataactttgacaaccgctaatgatactgtggagataaatccatccgagatcggtttgggtacgtttatctatgtgttgtatgtggacgggcagaaagcggatacactgaagaaatttgtaaactgattttttatgaaaagagatgttttatctacagtatgcataaagatatgtatgctgtcttacctcttgtttgttttttttgattcagtatcttcagaagatttaaaattcaaggaaaaaggagttgataaaagttctaataatatagtttccgatagtatggtatttgatcaacaagtagacagtatatctgtttttgctttgggggagtgtgtcgattcttatgaaaatcaaacagtgtcttctgttgtgttagttcagggatgtaatgctcttactgtaaaaaacgtgatagtctctggtaacggagatttaacactatcggcttcagatgccgttttgataaatggttcgtttgaagtgaagcttgggggacttttgaatataaaaaatgagttaactcaatggagcattgactatggatatgataatgcaggaaatagaattaggcgtagtgcaaactccatgaaattatctgatgtggattgatttttttaatcagagagtagaaaggcatattatgaagaaaaggataagtatatcaacaattgtattactttttgttgcgttaaaaatattggggcaaacgaatttgaaagttcgtactttaggtgattatgataatagaatatcagatacgataagtattgaaacagagctgatgccttcttcacttaaagaacttttgggttctcataatgaaggtgataattgggaacaaggacaatctgatgcttctatattatccatagataaaagtaaagaggttggtactattgttggtacagtcgatgttacagaaacaggtagtgctaattatgtaattccaatagaagtaccaaaggggatagccggtttagaaccatctgtttcaatcgcttataacagtcagtttgctaatggcctaatggggtatggatggaatgttgcggcattttctgcgatttctcgttgtggaaaatcatattattatgataatataacagaggcaccacaactttccaactcagataatctaatgcttgatggacaacgtttactgttaatttcaggacaaaaccttgtaaatggagccaagtatcggatggaatatgatccatttacagatatcacttacaagacagtgaactccattctatgttttgtggttaggacaaaagatggaatgacaaaagttttcggctccacttctgattcgaatatagagactccgagtggaaatacattattttgggtattatcaaaagtgacagataagaatggtaatacaatgaattataagtatgatgaaattgtaaacaatggtgagttttatcttacaaagatcgaatatgcaggaaatcgtagcatagaatttacttatgaaacaagaagtgataaacaaaagacgtattttgctggtgcacaaataaataacaataaaatactgaaaagtatctctacatacataagccaaaccaggatcagacaatatcaatttaattatacttatgatggtttctattctaagttaatggaattgatagaggttgggcaaaataataaacagtacaattcaactgttataaattacgggagtagtgaaactcaacagaatgaatatttttcgagtttatcacaaaaacgagaagggaataaacccctgtttgcggattttaatggagatggaaaggccgattttctttcgtatccggaaaaagactcgtatacaacttcagatgtagccactttatttatagcacagaaagtttatggaagtgttgactttgttaaaaagtgtactattcctattcagtcttcttccggagtgtttcaaggttttgttttagctgatctgaatggagatggctgtgtagatgttgttaatatttctaaggccttaaacggaacttatcgttataattattatatgtatgatggagagaaacttacatatgattacaagggatttaatacagatagtaatgaggcaattgtaggggattttaatggtgatgggaagcaagagttattgattgtcaataatcagaaggtttttgatggtgatgggaaggaaatagcttcggggggtattgatgattggggcagtgaatatattgaaaactattatcctaataatagatacctctgtgattttaacggaaatggtaaagccaatatacttgtaatgaatgcttctggaggttgggtgtatgaactaaatgggagaacttttgttcggttaagcacttttaatacgtctgaagtaaaaaattattatttcccatattttggagattttaatggtgatggttatactgatattttagttcaaaattatacttcaggtaatttcgatgatgtgtttatcttattttctactggaaaaggatttaccaagcaaaaaatattaaatgctgatattaaagcaaaagttagagtggctgatttcaatcgagacggaaagtctgatatattccatatggaagtagtgaacaattcagttcgcatgaaagttggtacttttaacggtttaaattttactacagcttattattcaacgtctttgactccttcccaaatatttgttcctgatgaatatgacaattatcttttgcaagtagaagattttgatggagacggtagaggtgaattctgttgtgcaagatatgtagatagttatataattcattcttttacagataatcagactttattaacaaaaacaatcacgaatggactcggtgcacatatctcatttcaatatgctccaataacagaggagagtgtttgctcaagtagtggaaataacacttcatatccaatatcaggtaatagagttcctttgtatgttgtcactaatgtagctcagaatgcgaatggatatagtgaaaatatatattatcgttataaaaatccccgaattcatttgcagggaaaaggatttttaggttttggtagtattgaggctgaaaattataataaagatagaaagataacaactctttatggttataatgaatattattacccttttattcaagaacaaaaaacaacaacaagagcgggagcgaatatatctacttctgtctatgaaaattcctatgtatatcaagggaataaacgtgtaaccccttatgtaaagaagttaacggagactgatcatttgacaagtattgtgaaaacagcagattgtacgtctactgatagttggggaaatccattaacagttattactaagtatggtaatgatcttacagaaacagtaacgaatacttacttgaacagtggtacagaaagtgtatggatatttagtttgcctctttctcaaacgaagcgaataacaaggggaagtgaaagttggatagaaaaacatacttttgagtataatgccagatatttgctaggcaagtcggtagaatatacttcagatggaaccaaaaaagtattagagaatatttttgaatatgatacattcggaaatacgacgaagaaaacggtaaagaactatgcgtcttctaatgggttagtaactaaatatgagtattcctcggatggagtctctctaactaaggaggttgatccgttattattagagaccacatggaaatataatttgttgggacaaatagtatccagtacagaccccttaaagaaaacgacaacatatgaatatgacaatatgggtgaattggttaaaaccatttatccggataatacattttcgacaaccatattgacctggagtgatttgccgacaaataccgtttactgcataacagagaattcttcaggtaatcccgttacgaaaaaatattatgatgcttttgagcgggaattaagaaatagtataatagaatttgatggttccgaaagaaaatatgataagaaatatgataatgccggtcggatttctcaggtatctctaccgtttaaaggtagttcggcaacgaaatggaatatttataattatgatacttatggacgattgataggtttagcttatgcatctggaaaatcagattcatattcttattccggtacgagtataacattaactaaaaatggtgtttcttcagaacaaaaatataactcgaagggagaactggtctctgtctctgaccctgcgggaaaaataacttataatctgcgtcctaatggtcaactttcaagtgttgtagctccaggggatattgtgacaacttttgaatacgatgagtatggtagaaaaaaagctattgttgatcccagtgcaggaagaaaaactttttcttatgatgaagctggtaatttaaaagaagagattgatgcaaacaatcgtaaaaaaatattttcttacgatgcctatggccgtattacatcgaaggagtttcagaatgaattcaaaacaacgtatatatatgaaaatgatttattgagttcagtaacttctactaatggaacctcacatacgtatcaatatgatagtaatatgtatggtcgtctcgtaaaagaaagggataatgggcctgatggaatgtggttggaaaagacctatttatattcttccggtaatttgtcttctattaactttacatcgcaagcaggagctatcggtacggaatcttatgtatattcaaatgggcatcgaagtgaaataaaatttggtggaactagtgtctggaaattaagtgcggaaaatgatatggggcagccggtatctgtaataacggggccagtaacacgctcttattcttttgatgaatatggtattccgactggtagaatgactacagcctcaaataataggaaattacaaaatgacacctatgctttcaaccgttcgaatggaaatcttacaactcgtatagataacacaagggagttatctgaaaatttcgcttatgataatctaaatcgtttaacacggtttgctggaggcgtagtgatgtatgatataaaaggaaatatcactcaaaaggaagatgtcggtaatcttttttattataatacaccaaataaaccttatgcagtatcaaaagtggatgcttcccgaaagaatgcaattcctccgagaagtcaagcggtgagttatacctcatttgagcgtccctcgactattaccgaaaatggaaatgaagccttgtttatctatgatttggctggagaccgtaagaaaatgcagttgaaatatagcggaaatatccagttggaacgctactatttaggtgaccgttatgaagctgattataagaactcgctggataagcaaatattatatattggaggagatgcctattccgctccggctgcttatgtgaatcagggtaactcttgggcattgtattatatttgtcgtgattatctgggtagtataacgcatgtgataaacagtagtggagctgtcattcaggaaaatagctttgatgcctggggacgtttacgtgatcctgtcaccagagttgcttatttgccggggcaggaacctaccttatttttgggtagaggctatacggggcatgaacatttgtcacagtttggtttgataaatatgaacgctcgcctatatgatccggccataggacgttttttatctcctgatccgtttgttcaaatgccagatttttcacaaaattttaacaggtatagttattgtctcaacaacccattggtttatgtggatgaagatggtgagatcttttggtttatagtcggaggagctgcatttattggagcgataacaaatgtggcaacacattggaaggagattaaggctgtaggtggttggaaaggcttttggaaaggaaccggttattttgtagtaggaggagttgctgccggtgccggtgcagcagcaggcgtagcggcggccgtaggatttggcggaatgatgagcgttacagcagctcaaatggctgctgcatccaccggatttatacctggagctactataggtgctgccggtggtgctacaagtggctttgtattaaacacgggaaatagtttgatggatggcgagcgatttggtggagctttgcaaagtggacttatgggaggaatcactggtggtgttttcggtggtttaactggtggattgattggtggcgctcaggctttgcaacatggtcgtgatttttggacaggcaaagctacaaatcgaggattgatgccaactaatacaacctctacaataaaaaataatgtaggagagggaaaagttattcctaaagacgagaatacatattcggtatatcaaggattagataaagaaggtaataccaaatatgttgggataacaaagagagatcctgaaataaggtttagcgagcatttgaattcaggtacaaatagagccgatttagattattctataataaaaggaacagggaatttaaataaaacagatgctcgaatctgggaacagaatctgataaataaatatggtttacaaaaggacggaggaacgttatataataagataaattcaataagtcctaaatattggaaacagtacaatattaagaaaccttgattcgttgtatttattagtaataaatcttttataaaaatggcaataagaataatgacaaaaataggagacatcttttgtgtagatattgagaatcagtgcaaaagatattttcaatatattgtgaacgatatggaacaattgaatagttctgtaattcgtgtgtttaaaactcattatccgatggatcataaacctgtttgtgatgaagttgtaaaagatgaagtcgaattttatgcacatactgtattgcggactggcattgtaaataatgcttggtataaagtgggtaagtcgaaagttataggatatgaatataaggaagtcttgtttgggatagcacaagattgccttggtgattctcctacaaatataaagtgggttgatccggttgaaaattggtttgtttggtatataaatgaaccaagtgttcgtattggaaggcttacggaagaataccagcatgttgaaatgggagggataatgtcttatagttctataattgatagacttagatatggatattatactaataaattcccaggatattagtttgtgaaaaagaattatgagaccacttcaaaagtcgtctcattaataaatatggcaaaacgaatagtaataaaaacaggggatatcttttagattgagactcaatctaaaagatatttttagtatatcatgaatgatatggaaatgttgaatagtttgtaattcgtgtgtttaaaacctattatccgatccgaatggtaaaagtataattcttgcagcagctattattggtggatggattggcttgggaagtgcttggtttccagtgataagagtggcttggaattggcaggtgatatgtttaaggggatgtttgttggagctgcggccggagcggctggtgcatgggctggtggagctgttgcgggttcgataacggcaggtggtttcataaatggaagtctttctgggctagcaggtggatttggaggcggttttgtcggttgctccggaaatgcttggttgtcaggagctggttttggtgcaggactgaaggctggatttgtaggaggcgcattaagtgctgcttttagtggtttatctggtggtctgatacgtgggtttacagatatggctaaggggtattccttctgggatggaagaacaacctctgagtttgtaataggaaattcaatagaaaagacagattataaagcaatgggagataattataatgatagttttattgctgaattgaatgatgaaagcttgaaaactagaattcaaggagagtatagtataaaagaaggtgatttgggcatagaaaaaataacaacacgaacaggagaaaggtatggtatgactacaaaagaatcatatgtaaacctaaaaaacggacacgaagttgctggatatgcagatttgtcctctacagggcgtagttcaaaaatacatatttctccgaaatacgcaaatgcattggatgtagctgattttagggctgtagctggacatgagctgattcatgcttaccaccaatatacttttgctggagcttttgtgagagcttcttctgaaagtgttgcttatcgatattcagcaaatatttatttgagggcatctcaacctgtaaaggcatttcagtggatgcaaaatgctgttaaccaacgttttttttggcactccagtagttatgaaattcccaatatttataggtttagataatgaaatacaaatttgtcatactatttatgttttgtgcaaatcctttatttgcgcaaagatatgttttgggtgaaagtaaattcttgaaccattggactcaggagtatatcgattgtcggttgtatcttttggacaataaatatactatgaaattctctttgatatcagatgatatagtttttaatatgtttcccttgtatgggtatgtccgaaaagagggaaatttatattatttgaaagatataccaactaatgctgaaatagtcttggaaaaggataagtcagctaatttcaacataaaaaagggcttttcatttatgcaaaagaaatgtcttacttatgaagacaaagctgatagtgacgatttttcttggtttgatattgatgttgaatatgataaaaagaagaaagaggttcaatcaataagagataaacagttacctgataaactaaagtttgggtttggagaatatatgaatgggaatgttcatgtgtttcttgaaggaaatggctcatatacaattgcatataaatttcaagagtatttgattgtaatttcagaaggaaaatgggcaaccagaaatggtattttaaaattaagagatccatttcttaattattcgtttacaatgttgataagcgtggatagacagttgattgcgattgattttccaaatgaattgaatgagaagcggatatactcttttgtggaaggaggtaataaatataaaaaaataaatttgcataaataggaaactgttttgatttttttatttaatcctcttgacacatgatttgtgtcggaaatgtgagaattaaagagattacgacaaagacaggacggatggggatgatgactgatggagtatatgttgataatggagctgaagttgctggctatatagatatactacagggaagagtttggtgcatatctctccgcgatatactttaggaaatgttgtggattttagagcggttgctggtcatgagttaaatcatgtatatcataattatttttttttaagagcttatgtgaaagcttattcagaaactgtggcatataaatatactgctagtgtataccaaaatgttggtagatatcagatggctttagatgtgacaaatatagcaaaaagcttagggtattcagggacctatccaagtagttataatttagggaatacgataaaatcaatgtgggtctattaaatttatgattatgttaaaatctttttgtgacttaaaagacactttagttcaaacgtatgaactgaaagatcctttttatgaaaagaatatttcatgttatttagaaatgataaataataaggagtattgcatttattttattattggaccaggtgatgataggctgattttatttctttctttcggatcaatgtctgtgaaggggagcagtattcttttgaatgacataagaagtaattcgactttaattctggaaaaaagagacaatgttgatctatttgtaaaaaaaggttttaaactaatgcatgggaaatcttttattcatgtaggtggatcagactcatttatacataaatctatattggatataaaggatgaatcagaaaaaaggaagaagaaagtagaggagtatttaagtttactaaattcagatcatgttcctttacaattgggagtatatgataatggatatgtttatttggatataaatataaattttaattttaaaatctattatttgatagaaagaaaagtttttttgttatcagaaggtaaatggataaaagatggtaataaattgcaattaaatgattcttctttggattattcttttttactcctaatagaatctaaatcattaattgctatttatttcccaaatgagataaatgaaagtgatcaatattctttagttaaaaatggattgtatgcgtttattatgcgatgagtgttaatgttcagaatattagcttcagcttggatttagataaaatagagaatgaaatatatgtatgataaaaaaggaatggtagaaatactaaatatgtatggtgaaggttaagtatatattaattgctgttttttctatgtatatagaaactatatttgctcaatattatgaaatgggagaacgtaaggttttgaataccaaaaactctccagaggcttattgtgagttacatttgcagaaagataaatgttatattttgtttacggaaggtacaggtgaactctcgtcgagtttttttgtctcgtatgggcgagtacatacaataggcaatatgtattatttgaaggatataccttgtaatgccgaaatagtattagaggcaaataatgataagtcagaatttgttgtaaagaaaggtttttcttttatggaaaatgaacggtttctatgtaaaggggaaacagatgatacatgtgggtatgttgttgatcttgaagttgagtgcaaaaataagagagaacgtgatttgcataatagaaagaagaaatcttcatatccgattccttttcgattaggtgtatataaaaatgaatctattactctgtctttagataataactatctttatcaaattcattatcatttgggtgagtactcaccaataatttctgaagggaaatggtcaaaagagggtaacttattgaagttatatgattcctttttagattattcgtttacagcgttgattgactccagcaaaataacagtaattgatttcccgaatgatgtttacccaaataagaactactcccctatagaaagtgaaatgttgccaactctagtggaatagtcatttcaatgtaatatgaataaattgtatatatatttattgtttaatgttcaaaatctactttcacttcttgtgaaagtagatttatccttgtcatggtctaggagtaaattaagtgtctcagcagagtatgatactatatcacatccctatttgtttgtgaagtattcgaatcttacacaagattcaatttaggtatacattagatataaatgaatatacaatggatataggttatattgtggaagtgttgttcctgatactttaagtgttgtattttaaaatgaatattaatgaataatttggacggaatatgaagtatgttttgagaatatgtgttgtttttattattttgagtgctagggcttatgctcaatcacctgtttcttttcaagtaaaggcgggagcaggtcttgcgagcatgtggggacagaacactgaagaaaatgccaaattcgcttatagggtgggcgttggtatggaatatggttttaataaaacctgggcgttacaaccttctctgaattttgtatcaaaaggatctaaagaagatggaaaagatttgggaaaggctacagtaaatatgctttatcttgaattgcctgttatgttgtcggcccgcttacatcttacgaaaacatctaacctggttatttcaggaggtccttatatggcttatggagtaggaggcaaaacatcggtcgatgtatggttaccgattccgggtactacagggattcagacagttcataaagagtataaactcaatacctttggtagtataaccgatgggaatatgggatgcaaacgttttgatgccggagttggactgggtattgcctatgagtaccggagaattgtagtgggcttggaaggacaattggggctggttaagatacatgacggattttccgaactaatagatataaaagagctcgaagataatgctcttaaaaatttatcagcgttcgtaacggttggatataagttttaaagaagtactgtacagtgttgcatatccaatgtttttgtttaattttgtttacaataaaggggttgttgtgagatattgaacagatagatggattttgagaatttttatataacatggtactcgcgtgttaaacactttgcacgcgactatgtcctttctgaagaagaagcggagaacattacacaagatgtttttcttgatttctatcaaaagagagattcgttggatttccatataaatgtgatagcctatttgtttacgtctgtaaaaaacaggtgcattgattacctgcggcgtaagctattggagcaggaagcagcttcgaagatgcaggaagattttgacttgtccttccgcatgaagttcgattctttggaagcatttgatatggacgggctttcggaggataatataaggaatataatagaaaaggcacttaacgcacttcccgaacggtgccgggagatattcatattaagtaaactggaaggaaaaaagcagaaagagatagcagaagaactgaatgtgtctgtaaaaaccattgaaacacagatgactatcgcttataaaaagttaagagaggaattaaaaaactatttaccactattgatgtttattttgtccttttgataaggcgtaaaaattaaaaatatggcagaaccttttaaaaacatgtataacgagcaatttttcgatagatttacgaaagatttgaaacttgttatcaaggattttgatgcccgtgagtttgtatcccaaataatggataatgaatgggaaaacagagagcttaaacaacgttgtatgcacattacaacaattctgagaaagtttttaccggcagattacaaagaagcgatcgctaaaatactagaactgttggattatgtaaaaaatacacagcctgatttttcaaaaattgatgatacgaagtttggcttaacattggagtatggtccggttttagataattatgtagaacaatacggattggacgattacgaaacctctgttaaagcgatagaaaaaatcacccagtttacaagttgtgaattttctgttcatccttttattataaaatatccggatgaaatgatgcagcaaatgttagtttggtcgaagcatgaacattggggagtaagacggcttgcgtcagaagggtgccgtccgcgtcttccctgggcgatggctttgccgaatttgaaagaaaatcctgccccgatcattccaattctggaaaaccttaaaaacgatccggcgagatttgtgcgcttgagtgttgccaataacttaaatgatatagcgaaagataatccccaaacggtgattgatttggtgaaaagatggcaaggagagtcgaaggaagtggattggattatcaaacacggcagccggacactcttaaaacaaggcaatcaggagatgatggaactgtttggttttaattctacagtaaaaagtatccgcattgagaattttcagatttcaataccccaagttaaagttggagagtcgttggagtttagttttaacttattgaataagaacaataaaagaaccaaaatacgacttgaatacggaatttactaccaaaaagcgaatggaacgttgacaaagaaagtccacaagatcagcgaaaaggagtacgccgaaaattctacaacacaaattactcgaaaacactcttttcgcgtggtaacaaccaggaaactccatcccggacttcatcaggttgctgtaataatcaacgggaatgagtttgaaaagtatgattttgagctgattgaatgataaatacggcatgtggtaattagtcttccggggaaaattgaaaaaataatcagatttctttagggggatttttttttctgttcgtttactatataaagaacagtgaataatggatgaaagaatcataaaatattgccagggagtattaccgaagcaggaacaggatcagcttttaaaagaagcttataatgatcctaagttgaaatctcaaatcatagactatcaacatttgcatagtctgttggagttggttccggaaaaaatagatgtgcagcagggatctgaaagatatggtaactttaaaagacttgtgaattcacggaaaagaaaagtttggctgatctcgttcagccggtatgcagcaataattgtgatcgtctttgtgtctgcttggatgttggcatcttactgtttctccggagatatcacaaaccggcaagagttgatcgcttttcagcaggaattagtagttccggccggacagcgtgcagaacttacattacctgacggtacgaaagtctggctgaatgctggttctaaattatcctatccttcttttttcgaaaaggaacggaaagtttttttgtcgggtgaaggtttttttgatgtgagcaaaaataaaaaggtacctttcattgtctctacccggacgatggatgtcaaagctctgggaacccagttcaacgtattctgctatccggaaagtaattatacaggcgtttatcttcaggaaggttctgtgaaagcttactttccctcttccgaggctgaaggtgtgatcctttctccggaacagtatcttgttcaaaaaggaaaacagttagtgctctctacaatggacccggatgaattattatggcgcgaaggtatttatacgtttaaaaggcagaagttgggaagaatcatagagaagttggagttgtattatgatgtgaagatcgttgtgaaagatccggaaatattagattatgaatatgtcgggaagttccgtcaaagggatggagtgatggagattcttcatctgatccaacggatacataattttaaaatcaagaagaatgatgaactgaaccagataatactgagtaaataaaaatagtattaacctttaaatttagtatgtatgagtccatgaagaattaaaaaaatcggcagatattggcctatctaccgattttacgaaaagtaaaaccatttgtgttcaaaaaattagtatttacttaacaaagcaaagatatgaaaataaatcctttgttaccgcatttcttatgtctaaaaaatcaccaaaaggcattcagaattatgaaactatccttttttatcctgtttgtttttgtgtgccagttatttgcattgaatactgatgcacagactgttgttgtcgaattaaaatcgaataaactttcaattgaagaattgtttaaggaaatagaaagacagactgactatctcgtcatatatagtacgagtggtgttcgttcaaacttcgatttgtcattaactaagaagaaagccaaagtctccgagtatttggatgaagcattgagaggacatggtttgaaatatgagtttgtcaataattatatcatattgtcgaaatcagaagaggctgttgtccaacaaaatagaattaagatcgaagggactgtttatgatccggccggagaacccatcattggagccaatgttgttgaaaaagggacaatgaatggtattatcacggatatagacggaaagttttttttggatgtcgtttccggtacaactttggttgtctcttatataggatataaaacggaagaagtggcagtaggtaataaacataacctgaggataaccctgaaagaagattcagaaacattggaagaagtggtggttgtcggttatggaacacaaaagaaagtaaacctgacaggagctgtttcacaagtaacttccaaggtgttggaaaatcgtccgataacgaatctgggacaaggacttcaaggggtggttccgaacctaaatatctcttttaacggaggcgatcccaatgctgaagtaagtatgaatattcgtggtctggcatctatcagcggagaaggtagttctcctttagtgatggtagatggtgttcagatgaatatgaatatggtcaatccggaagatgtggaaagtgtatcggttttgaaagatgcttcttcttcggctatttatggtgcccggggtgctttcggcgtgattctgatcacaacgaaaaaggggaaaacggatcgtaaaccggtgattgaatattccggaagtatccagttgaatacacatacttatttaccggatatgctgagtgctcccgattatatggatgccatgaatgaatcttcgttcaataatacgggtaaagacaaatattcggccgaacaggtacaatgggtgaaagattattataatgacccggttaataatccggtttaccatatgatggagaatggtaaaattttctggaattcaaataataacaactataaacagatgcttcagaaatgggctcctacccataaacatacggtaaatatcagtggaggtagtaaggctatccgtttctatgcttcagcaggttatatgaaccaggaagggatgtttaaggatgcgaccgatatatttaagaggtataatttcctgagcaatatctctgcagatctgactcctaattttcgtgtaggctttaaagcatcctatacacatacggtatatgatgcacctcatgcttactcaacaaagggaactaattggtgggaacagatgacacgcggtgaaccgcagatattattcccggtcacaacacctgaagacagccctgtcggcggtggtattccgacggagcatttttataatttcctgacaagcggttcaagaaatgtgacaaacaatgacctgacccttttgatgggtaatgcggaatgggatgtggtgaaaggcttgaagattaaaggtgattttagttatagagctactaatgacagacagaaagatgtgcaaaaggaatttgattatatccgcgattcctggactacccaaaatagtgcgaccttcccttcctctatcctcgctcagaatgcacgaagtaactattttgctgcgaacctatacggggaatatatgacatcgatcaatgaaaaacacaatattacagtattggccggttttaatcaggaatgggaaacttaccgggaagattataccaaacaagaagaactggtatcaagtgatattccttcgatcagcttgggtacagggaaagtaacgacaaaagataaggagtacagttgggcgattcgtggtatgtttatgcgtctgaaatatgactatatgaataagtatttgtttgaaatgaatggtcgctatgatggtacatctaagttcccgcataattcccgttatggtttcttcccttccttctctgtcggatggcgtatttcttcagaatcttttatggaatctacacattcttggctgaatgatttaaaggttagagttaattacggtagtttggggaatcagaatgtcaaaggttattatccttatatttccacattcgaagtaacgcagcagactccttttatcattaatggctctttacctatttccgttgctgctcccggaatggtttctccggatctgacatgggaaactgtaaagtctttaaatctgggtattgatataacggtattgaatcgtttaagtgcaagctttgattggtttaacaggaaaactaccaatatgctgactgaaggggataagcttccgtctattttaggaacagatgttccaagacgtaataatgcagatatgaagactgccggttgggagctttctgtcaattggagggatcagctggctaacggtttttcttatgatttaggtttgattctgtctgactatcagagtgaaattaccaagtttgataataatccgagtaagttatatgataattattatgtaggaaaaaagattggagagatctggggatatgaaactgtcggaatcttccagtcgaaagacgaagtggctgcggctgccaatcagagtaaattaggtaatggcgataaatggggacctggtgatacacattatgcagatttgaatggtgacaaaataatagattggggtgataaaacggtagataacccgggcgatacgaaggtgattggaaatacgacgccgcgttatcagttcggtataacggccaatctgggatggaaaggttttgattgtaatatctttattcaaggtattggtaaacgtgatttcttcccgatcggtagttatttctggggacatattaataatgcgaatgctgtcggtacctatgaagtttataaaaatgcctggagagaagataacccgggagcattttaccctatgtggaaagcttcttcaatgagttataatgtaagaacacagactcgttatttacaaagtggagcttacgcacggttgaaaaactttacagttggatatacgatacctgctgagatcacccagaaagtcagattgaacaaagttcgtgtttacttttccggtcagaacttattcgagattaccaatatgcgaggtaaattcgatcctgagcttatcggaaatgtggatgatgaaaaatcaaagtcaaatgtaggcaaagtgggtgaattttatccattgcagcgttcaattttattcggtttacaattatcattataattagagcaatatgaaatcaattaaaatattacttgcaggtagcatcatgttggcaacgttagttgcttgtaatgatgattttatggatcgttttccgacaacagatatcagtgatcagaatttctggcattcggccagggatatggagttgtattgtaatggtttatatacttatattaaaggacatggtaccggtcacgatagaagcccgatgttatccggtgataaccagagtgataatatggcccctcaggattacgataaagtggctgccggcgaacatatagtaccggaaagttctaatgacaatgaatggaattggacttttatccggaagtgtaattatttcctggcccgttatcagcaggcagagatcagtcaggaggaaaaagatgcgtatgctgctgaagtatatttctttaaagcctgggattattttgagaaagtgaaacgatatggagatgtaccctggttaacgaaagaccttacaactgaatcggaggagctttttggggcaagggattcgcgtgttgaagtgatggattctgtgttagcttgcattgattgggctattgaaaagctaccggcgaaaaagaatgctgtttccggccgtatcaacaaggatgtagcactgatattaaaggcgagaatctgtctgcatgaaggaacattccgtaaatatcatcagattgataattcagaaaagttcctgaaggaggctgtaaacatgagtcagactttaattaaagaaggtcattaccagatttataacacaaataatccggagtctgattaccgtacgcttttctgttctctggatttgaaggataatccggaaatgatttattataaagtttatgaagaaggattgttaggtaacaggactagtaatcttttggaagggggagaatcaactttaggatttagtgtgacaaaatctttaattgatgcttatctttgtgaatgtggaaaaccgatatctctttgtaaagaacatttcttgggacatgatagtattcaggctgaaatgttacatcgtgatccacgtttgtgtcagacgatctgttatccgggaaaagatttgcaacgggatacgaagaaaccatctattcctggttcaaatatttctacaggaaatattccgaccggttaccagatcataaaatattgggtagacgatccggcagaatatttacgttatcagaacggtattctggatgctcctgtattccgttatgcggaagccttattggtttatgcggaagcgaaggcggaattgggcgagtgtacgcagtctgatttggacctgtctgttaatttgttgcgtaaacgcgcaggtatgccggatatgaaaatcgatcagctggtgaaagacccgatgtctgattttccgtctttaccagtgctgatagacgagatcagaagggaaagacgtgtggagtttgctttggagaatatgcggtatgatgatttgatgagatggaaagcgggtaagctgatggaaaaaacggttcggggaatgaagtttgttcagtctcagtatccgacagtcgttattggtaaacatatcgatgtggataaagaaggttttattttgccgtattggaatattttaccgaacggacgtaagttcgatgaatcgaaacattattatttcccgcttccgacagaagaattggttattaatagaaacttaaaacaaaatccaggttggtaatcgattatgagaaagattttttattctgtagccgccttggctacattgaattgttcggtgtgggcaaaggggaaagagactaagaatgtattgtttattttggtagacgatatgcagaaaacctgcattcatgcctatggcaataaccaggtcgtatcccctaatatcgacaggatcgtcgatcagggtatttcctttatgcatacctatacgaacggttctttgggaggtgctttgtcgatgccgagccgtgccatgatcatgacgggtagaggtgtctatgaggtaagtggagacggtgcggtgattccggaacaacaagttaccttgccggaattgttgcggtctaacggttatgaaacgtttgccacagggaaatggcatgcagatcccttgtcgtttaaccgttcatttgccaaggcagaaaatattttcttcggaggaatgcattcgtatgcaacggacgggcatgtatctccccgtctgaatcattatgatccggaaggaaaatatgaaaagacctttatcggagataagttctcatcagaaatgtttgccgatgctgctgtcgattatctgaataaaagaagtaagaatgataaaccgttcttcgcctttgttgcttttacttctccgcacgatccgcgtatgaagcatccagaatacggacatcactataatccggaagatatggagctgcctgttaatttcctgccgcagcatccgtttgacaacggtgagttaaaaattcgtgatgaggtattgttacccttcccgaggacagaggccatgatgaaaaaagatttggctgattattatggaatgatcagtgaagtcgatacgcagatcggacgtattatgaaaactctgaaggacaaaggagagttggataataccatcattgtttttgcttctgataacggtttagcggtaggacgtcacggacttcttggcaaacagaacttgtatgagcatagtgtctgtgtaccgatggctatggttattcccggcatggaacaaggtacccggaaagatgtggattgttacctgtacgatatctatccgaccctttgtgatcttctgaatattaagccggcagaatctgttacaggaaaatcgctggctccggtattgaatggggcggaaaaacacagggatcagttgttcctggcctacaacagtttccagagagctctggtgaaagatggttggaaatacattatttataatgtggatggtgccgttacggaacagctgttcaacctgcagacagacccggatgaaatggtgaacctggcttctgatgcaaaatacgatttcaaaaaacaagcttacaagcgtattttgaaagaagagatgaaaaagaacaatgatttctgtaatctggatttacattactggatgggaagaccgggaaagatgtcctgggatgaagcttctaaattgtatgtttattgatctgatctgacttcaatttcatatttagagaaccgtatgttttctttagcgcaattttatattgtcgaaaaagaaagcgtacggtttttccgcatacctatgcggctttatggagataatcatgtatatttgcaagttataaaagatatctcgggcatatttcggatatcatttaacgaggatttatatggcaaagaaagcaactacaacaaaacaaaatagtaacaacgaacctggtaagttagccttgatgaagatgttcttcaccaacgagcgtacccgttttattaccggattggtaatagctattattaccatttatatcggattatccctgatctctttcttcttcacgggaggagcggatcaaagtaagatcgagaatgtcccgttatcggatttgctgacgaacagaggttcggttgagaactggacgggggtgcggggagctgtcctggcagacctgttgatgaaccgctggtttggtatctcttcgtttatgatcctgtttttcctaggatcggtcggagcgaagctgatgaatctgcgcagggtgtcgttgttgaagcgtttcctattctgtgcggctatgcttgtttggggatcgctgttctttgctttcgtttttatcagcggatatgaagatacttttatttatctgggaggacaacacgggtattacctgtctgaaatgatgattaccaatatcggtatccccggaaccatcctgttactggccggtattttcctgatcattgccatattcagcagcaagaaaacgataccgttcctgcaaagcctgctttctttcggttggttgaagaaccgtctgaaaagagaaaagaaagaagatacagaagacgatacgacttcggaagacgataccgcatccgaacatcttattgccgaccagccggacgaacgaccggaaacggatgattttgtttttgatacggcaaaagaaatggagtctgccgacgaggtggaacgctaccgtaagcctgaaccgcgtactgaaacctattcgaatatatccaacgacgatacatttgaagtaacagtcccacaggaggaagaagcgtatgatattccggatgcgggaaatcaacccgatgatccggaagaccttccgggagatcctcgctttacagtcgaggttccgaccggtgacgacgaagtgtatgatgcctctgctttgggtgattatgacccgaaactggatttgtccaacttccgtaatcctccgatcgaactgctgaaaaaatacgatgtgagcgaacatcaggtcgacatggaagaacagatggctaaccagaaacgtatcaaacagactttggaaagtttcggtatcagtatctcttctatcaaggcgacagtgggtccgaccattacattatatgaagtaattccggataccggtgtccgtatctcgaagatcaagaacctggaagatgatattgccctgaacctgtcggctttgggtatccgtatcattgccccgatgccgggtaagggaacgatcggtatcgaggttccgaacaaagacccgcagatcgtatccatgcagtcggtggtggcttctcgcaaattccaggagtccaaatatgacctgccggtagtattgggtaagacgattaccaacgagatatttatgttcgacctgtgtaagatgcctcacttattggtggccggtgctaccgggcaaggtaagtcagtcggtctgaatgcagtgataacctctttattatatagaaagcatccgtcggaattgaagtttgttctggtcgacccgaagatggtagagttcggaatctattcggacctggaacgtcattacctggcaaaattgcctgatgcggacaaggcggtgatcacagactgtacgaaggtgattatgacgctgaactccgtttgtaaggaaatggacgaccgttatgaattgctaatgaaagcgcatgtgcgtaatataaaggaatataacgctaaatttacctcccgtcacctgaatccggagaaaggacataagttcatgccgtttatcgtggtgattatcgacgagttcggcgacctgatcatgcaggcaggtaaagagatcgaaacaccgattgcccgtatcgcacagaaagcacgtgccgtcggtatccatatgatcattgcaacgcagcgtccgtctaccaatatcattaccggtatcatcaaggcgaacttcccggcccgtatggcattccgtgtgatgcagatggtcgactcgcgtacgatcctggatgcacccggtgccaaccagttgatcggtcgtggtgacttgctgttctcgcaaggtggagaaacaaaccgcgtgcagtgtgcctttgtcgatactccggaagtagaacagatcgtaaactatatctccggccaggccggttatgctaccgccttcctgttgcccgaatatgtgggagaaggtggcgaagataaagctccgggtgctgtcgacctgtcggatcgcgatccattgtttgatgaggctgcccgcctgatcgttatccagcaacagggttccacttcgcttatccagcgtaagttcgcgatcggttacaaccgtgccggacgcctgatggatcagttggaagcggcaggaatcgtaggaccgtttgaaggaagcaaggctcgtcaggtcttgatccaagacgagtataatctggaacagttactgaactctttgaaataatcgttatttatggaaagagaaagaaagataaagatatggcggaagatcgcctttataggtttgttattatgtctccttttcggtgtcagagtgataagcagggcacaaaatccggtatcgattctcgataaggcagcttctgcctacgaaaattccaatggcatctctgcttcctttgctttgaatacccgttccgatatgcagaaaatgtcggaaagtttcgaaggaacgatcaatatgagaggggataagtttaccttggtcactccggatatgattacttggtttgatgggaagacgcaatggagctacgtggaacgtaacgatgaagtgaatgtcagtaccccttccggagaagaattgcagtttaccaatcccgccattttattacgtgtatataagaagggttttactcctaaatatatcggggaaagtacggcagcgaacggaaaagcggcttacgatatagaactgacgccaaagaagaaaggagatatcatccgggtggaattgcagatcgaaaagttctcgaacttcccggctgcaatcaaagtcgaagcaaaaaacggcattaccaatacgatccatatcagtaaactgaaaacgggtgtaaaccaaccggacgacttttttgtttttaaggaaggtgactatccggatgcagaggtgatcgatctccgttaaaagacagtagagtgattccttagattaattatcaattatcaataaataaacgctatgagcaattcaacaaatgaaaaggtccgttgcctgattataggttccggtcctgcaggatatacagcagcaatttatgcttctcgtgcaaacttatcacccgtattgtatgaaggtattcaaccgggcggacagcttacgacaacaacggaagtggagaacttcccaggttatccggaaggtatcaccggtccggaactgatggaagacctgaagcagcaggcattgcgttttggtgcggatattcgttttggaattgctacggaaaccgatctttccgctgctccttacaaggtgacgatcgacggtgaaaaagtaattgaaacggaaaccctgatcattgcaaccggtgcgactgccaagtatctgggtatccccgacgaacaaaaatatgcaggaatgggtgtttctgcctgtgctacctgcgacggtttcttctaccgtaagaaagtcgttgctgttgtaggaggtggagatacagcttgtgaggaagctgtttacctggccggattggcaaagcaggtgtacctgatcgtccgtaagtcttatctgcgtgcctccaaagtgatgcaggagcgtgtattcaatacgccgaacattatggtattgttcgaacacaacacgatcggcctgtttggcgaaaatggtgtggaaggtgctcacctggtaaaacggatgggggaatcggatgaagaaaaggtggatattgccatcgatggtttcttcctggctatcggtcataaaccgaactcggatatattcaaaccgtggatcgaaaccgatgaggtaggatatatcaagacaatacccggaacgccgcgtacaaaagtggcaggtgtcttcgcagccggcgatgtggccgatcctcattaccgtcaggctattactgctgccggaacaggttgtcaggcggctatcgaggctgagcggtatttgtcggaaattggaaaataacgaaaaagtactacctttgcccgctgaataaataagtggaaatgagaaagtattgcctgttattcctggtccttttattgcttcattcgattggagcagttgaatctccgaagcacgagatacgtgctgtctggctaactaccgtctatggactggactggcctaaaaagccggctacaacggaagcgggaagaaaggcccagcaacaggatttatgcaatatactcgaccggttggctgatgcgaatttcaacaccgtatttctgcaagttcgtttgcggggggatgttatttaccgttcggcaatagaaccggcatccaaaactttctcaggtaaatatggaacaatgcccggatacgatccgttggcttttgcgatagaagaatgtcacaaacgggggatggaatgccatgcctggtttgtgacatttcctgttggtacggagaaggctgtaaaagaacaaggtaaattatctgttgtaaaacgccatccgaaactgtgtaaacgtcataacggggaatggtatctggatccgggtgtgccggagactgccgattatattttatctctggtaaaggaggtggtgaatggatatgatatcgacgggatccagtttgactatatccgttatccggagcaggccaagagtttcccggataaagccgttcataacaaatacggtaaatcgcaaaaactgcctgactggcggcgcgagaatatcaataaaatggtttatcgtatctatgactgggtgaaactggttaagccttgggtgcaggtcagcagttcgccgttgggtaagtataaccggatcgaacgggttcccaatgcaggctggacagcttatgaaagtgtcttccaggatcccaagatgtggatgcagaaaggaaagcaggatatgatcgttccgatgatgtattatctgcatgaaaacttcttcccgtttgtagacaactgggtggagaattgtaacgggcgcctggtcgtgccgggactgggagcttaccgcatggagaagaatgaagcggactggacggtaaatgatattaccgaccagattgattacagccgttattatggaggtgcaggctgtacctttttccgttgcgagaatgtgctggataattcgaaaggactttatgatgagttgaaagataattattataaattcccggcccagctattgcctctcacctggttgagcgatagggtgcccgctgctccggcagagatccgtgtggagaaggagggaagcgacctgaaactgtcctggcagaaaccaccggtggagaaggaagatctgacttatacggtttattattcattgacggactctatcgatacgtcgtcggctaaatctattttggctaccggagtgcgggatacggtactttatcttccggttgccccgaatgcggagagaggatatagcttcagcgtttcggcttccacccgctaccatatcgagagcgctgtgtctcctgatacttattattatctttccgaatttcctaaataatattaacggttaggagcggataggtgaaagcactatctttgtgtcgaatgaaaaatactgtaacatatctgtttatcgtttttctggcgactcttattttttatggaggtgccggagtgaacctgattacctattgctgcggtgattgccgtaccgaaggagttgcagtattattgaatgataactgttgcgaagtacacgaacatggctgttgcaatgccaccgatgaatcttcggtttgccactccggctgctgcgaagatgattgctgtggcctggaacggatcagtttcgactggagcagttccaataatccgatagtagaattacaaccggcagtgaccgaccttatgtcgtttgcttctccaatagcctcactcgttccggttccttccataaaagaatatattgcacaggatcaggatggccctcccattgtctgcccgcgtatttacctgaatttacttactaccttattgatttagattgtcattgtgcttttgcggcagcaatgtctctgcgatgtcacaacagtgccacgtagatgacaatgttttgccacgctgttggcaaaagctttcactcaggacaaagcaggcctaacgttacgggtctgtttggacataccttcttactgaatcaaaatgtaaagcaatgttgaaacaattctatattactctatttatactattctccgccatcgcagcccgggcggaagaagtgaaagggcatgtgtttgatgataataaccagccgataatcggtgccaatgtttattgggaaggaacccaacagggaaccactactgatgtagacggtgctttcgaactggctacgagaaaaagttccaataatctggtcgttagttatatcggctatacaactttcacgatgcaggtaacaaatccgaaggaaccgttacggattatcttgaaaggcgaagtcgccttggaagaagtcgtgatcagcgaacgtaaaatgggaacgatcgcctcccgcaccagtgtgttgcagacgcaaaagatcacctatgatgaaatatgccgtgccgcctgttgtaacctggcggagagtttcgagactaacccgtctgtcgatgtgtcttatgccgatgctgcgaccggtgcccggcagatcaaattgctggggctgtccggaacgtatgtgcagatgctgacggagaattatccgaacttccgtggagccgcctccctgtacgggttggattatgtgccgggtgcctggatggaaagcatacaggtttccaaaggtacttcatcggtaaagaacgggtacgaagcccttgccggacagatcaatgtggaatttaaaaagcctcctacggcggatatcttttcagtgaatttattcggaagcgatgccggacgttatgaaggaaatgcagatgcctcctggcatattaacgataaagtatcgaccggtttgctggttcattattccaatgacaaaaaacaacatgacggcaacgacgacggcttcctggatactccgttgaaagagcaggtcaacctgatgaaccgctggtatcataaactggataattatgtagcccagtacggagcccgctacctgcacgaaaaccgtaccggcggacaggctaccaaacatcatgactttgccgatccgtatcaggttcatctggagacgaaccgggctgaactctttaccaagcaagcctatatcatcgataaggaaaaggtggagagtgtagccatgatcctttccggctcttatcatgaacagaaatccatgtacgaccgtacgccttataatgtctatcagaataatgtgtatgccagcttgttgtatgagaaagagttttctccggcacatagcctgagcaccggcttgagcatgaattacgacggcttcgatgaaaacctgttgcaggatggtacgcgtaaggtcttcgaccgtacggaagttgtcaccggagcttatgcacagtacacttacaatctgaacgataaactgatccttctgggaggtatccgtgccgattacagttctttgtatgatttctttgtcacccctcgcatacatattaaatataatccgttcgactggttccatatccgtgcctcggccggtaaagggttccgtacggccaatatcctggcagagaataatttcctcttgtcgagtagccgtaagatgaatattgccgagaacctggatcaggaagaagcctggaataccggcttgaacctgtctttttatatccccctgttcggaaaagaattatctttgaacggggaatggtattataccgatttccggaaacaggtggtggtcgatatggatagcgatgcgcatgctgtcagcttctataatctggacggaaaatcttattccaacagtttccaggtggaagcgacctatcctttcttccggggatttaccctgactgcggcttatcgttacacggatgccaagacggattaccggaatgcagaaggggtaacgcaacggctgaagaaaccgctggtcagtgattataaaggactggtgacggcttcttatcagaccccgttgaagaaatggcagttcgacctgaccggacagtttaacgggggagggcgtatgccgactccggatgctaccaatccgttgtgggaaccgaactttaatgcatataccgttgtcaatgcacagatcacccggtatttccgtcgttggtctgtctatatcggggcggaaaacttgtttgactacaagcaatctcatccgatcatcgatgcggagaacccgcgtggagataatttcgacggttcgatggtgtggggccccgttcacggacgaaagatatatgccggcttacgttttaacatcagccgcgattaaaaaacaagataaattatttaccaattaatacaaatacattatgaaacagttagtagtagcattgatttgtgccgtatttactttctctacggcttatgcacaggatgcaaaaaagaaaaaagacacagtgactttttttgttgaagagatggaatgtgccaattgccagaagaaggtagaaaagaatatagctttcgagaaaggagtgaccgatctgaaatgcgatttgaaaacccgcacggtgaacgttacctataaaacagataagacttccaagacaaaattggcttcagcctttaaaaagattggaatggaagctgtgcctgtcgatgacggtgccggctgtccggttaaccctgcgaaaaaaaattaagcagtctatctccgttaacatggaaattcgttagaacatcttatctttgcaaaagcatacctgttggggcggatctatgtgtccgccccttttatggaaaaaaagttcatgaaacatgcagcgttttgcaccagaataacatcattatagttgaatggacgagtcacaactgataaggggttgtaggaagggggacaggctggctcagaaagagctttacgagaggtattcccgcaaaatgatgggagtttgtctgcgttatgtgaacgacagggagactgcccgcgatttgttgcaggatggttttgtaaaagtttttaccagtatggactcttattcgggagccggttcattcgaggggtggatgcgaaagatctttgtaaattgtgcattggagtatttgcgtaagtcagatgtattgcgcgagtcgaccgatctggataacacggcggaattgatccagccggacagttcggttatatcgagtatgtcggcagcggagctgatgacattggtacatgagttgccgaccggtttccgtacggtgttcaacctgttcgcaattgaagggtattctcataaagagatcagtgagatgttgaatattacggaaagtacgtcacgttcacagttcacgcgcgccaaacagatgttacagaagaggattaacgctttgtattgaaaggaaagaatgaaaaaggaaagagatacatttgatgatatgttccgctcgaagttgcaggatttcgaagtggatacgatgccggaagactggggggctattgccgatcgtttaccggtaaaagcaccggtatctttccgtcgaacgctccgttactgggctgctgcggcagtcatttcattactgatgataacgggaggcgtttatatgtttaaatcggagagggaggtagctccgatagcagagaagatcgagaaggaaacaaagaaggtggaaactgagctggctaaagatgtcgaagctccggttgctcagatagaggaaaaaataaccgtatctcctgtggcagcagtgcaacagccggctgtagtacggtcaacatacaaagctgccgtaaaggttgctcatactgaacctgccgttatttcttcagatgatgatttggaggagcaagcagaagtaataaccgatccggatgaagactctgttgtggttgatagagaagaggttgtgcaggatcatccggaagtgggttctattgatacccggtcgttgatagctgatgctgctccggtcggaaaagtggaaaaggaggttgctccgcgtaagtggggattcggtatgggaggtggtagtgttacaaccggaacaaataattcgttgaacacctatgccttgaagaatacaatgatgacagatcaggagttgttgttcctgaactctcctaattttgagaacagttcattaccgaagacgaacatacatcataaaactcccgtgtccgtaggtttttcagtaagtcgttatttgaataaccggtttgcattgtcgacgggattgaattatacgtttctgtcttctacctgggatgtggatgctccggtctattataataagacagcccaaaagctccattttatcggtattccggtttctttgtcctataaaattgcagaatggaaccgttttcaggtatatgcagcggcaggtgttatgacggaagtcaatgtatcaggaaagctgattacggaaaaatattcaggtaaagagttatacgaaaaagagagtgagcatattcgtatgaaggaatggttgtggtctgtcaacgcccgtgcaggtgtgagttacccgttgcttcgttttgtaagcctttatgctgaggctggagtagactactatttcgataacggcagtacaatcgaaaccgtacgttccgaaaaaccatttaatgtaagtctccaggccggattccgtctgggtttctaaataaacaaatactaataacataaaataaaaagaacagaaaaatgaagaaacttaagtttttaagtgcagtagccatggctacggttttgttgacctcttgcttggatgggggaaagaatgagcagagtggtgtttcttatggtgtagtaggtttttctacggatgctatggggtatgttgcttatacagctgatgaagttccggtatatgcttctggttttaataacctaaaggatgatgaatgtgtcttttttgcgttcaacattaattatgatgatccggctaataatagtggaaaaaaatatttaacggctactgtttctcaatattccaggttgaataatactggtagggtagaaccagttgatacagctaagacatccccgacatcaattaaacagggggaaataacagctgtggatgcagggatcgtgactacgggtgcatatagtgctactataaaagattttttattcttaggttctagccatgaaaaatcggcaaacgatcagacaaacgagtattttctgcagattgatccttctcaggaaccacaagttgtagacggtaaaaatatttatgatttctttttgcgtgtagtaaagaaagaagatggtaaaaatacaattgggacttctgtatttaactatgcaattcgtgcgggtaattatatatcttcattagaagctaaggaaaaatcaaaaggaagtgaaactttcaactttagaattaattatatcaaagaatttaataaagatacaacagaagctacatggactaagtcgaaagttttttcatatatgatcaataaagaaacgaataaataagaaactgataatttatgtaaaaaggagcttgttagggctcctttttttattgggtaatcaatcgataaactttttgacttgctgtaaaagagcccctttctccatcacacctgaagtccgccaaacagcttctccctttttgaagatgattaatgtgggtactgactgaatgcggtactcgttggcaacagcttcatttttgtcaacatcgattttcagaacacgtgcctgtccgattaattcttttccgagagcttctatcgttggactcatcactttacaagggccacaccaagtcgcgaaaaagtctactaatacaggtttatctccgtttataatatctttgaaagtttccatattgtttttctatttataacaattggaatgtaatgcttgttcatcgaacagatgaagccggttattttatttcattaataacggtttcgctgttttcaaaaacgataaatatgccttcccatttgccttctttctcatagctatcaataccttctttctcaacaaaacggattcgatatgtcgcttttatctttttcattgtaaaagttgagctgtttcgtaactcacatgagggagctaacgatattgtttctgtagttgttctgtttggaggaagaggtgttttttcatttttgaaaggtgcttttctatctccaatgaaatatttgtattcagaagataacaattcgaatacatcaggaaaagcgatcgttatctcttcttccggcaaataaggcaatatattttcatcaatgaaaaactgagaggattcttctactttttcagatgaattaataacaatgtcttttgttgtattccctgtattacggaaaacctgttcaggtgtttttatttcaaaaagttcttctccgtcaccttcctgcaaagcccacatgatagaactaaattcatattgtttttcttcgattagttcttcgtcattgtctttgctacatgcaataaacaaaaaaacagataataataaaaatagcgatccgattatattcttcatggcctctgtgaaattgattgtatgcaaatgtatataagataattgcatatcaatggattaaatgtaaattttatggacttttaaggttgttgatacaaattatacttctataaaatcgttcttaatactttcaatcaatttttcattgatatccaattcctttgcataatcctcgaaattagcgatcgcattggaaacaccattaattaatgctttataatcttgtatatcgttatttaaagctatagtttcaaaatcttcataggtaatgtcttcgtttttaccattaacagttaatgagtgcctgtttgaatatggaggagcagttggatctacgctgtaagttaaatcgtatgcaggtgatagccgccatgcaccctcacgattcatacaaaacgaaaagtttttagaatgatcatcgacattccgggtgataacattaaatatcattcgcaagtattgttgtttactatcctcatagcgtagattcagtcgccggattactgcaaaaatatcttcataactatcacttgtcggtgacatagctgctagtgtttgtgtatgtatttttttgttcccataggttattatttacttagttttttaaataagctccgtgggctttccggtaattccggcaatagtttctctatttcatccagactgtcgattgcccgtagcaattttataaacgaagccaatgtaataccggtagaagaaccgttctcaaaggaacttatggtaaacacgctcagtcctgatttctcagcaacttctttttgtgtgtaccccatccgttttcggtagtcactataccgttttcccaattcccgaattatatcacttcctgatttttcatatagttcactatacatactttctcttgtttgcttacaaatataggtaaatctataatagtatcgaataattatgagaaaatatagatatatctgttattggtcgagcttaatcgatgttattctcttgaaatgctttacaaagatatgaagtggatatggagcggatggactggatggaacccaatgggaataatagttggttttccggaagttttttaattgatttccgtctataaaaacaattgtatttgtgttcaaaagcaattgtttttcaaatcaaatacaattgtatttgtaactgaaaactattgtctgtgtaaactctgaaataaaacaggcagttttcagtaatacggggatagggaagattgcctgatttgccaggcaaaatgaaatgtcttctttgaatccttttaaaactgaaaaatggcgatagccttatataatctttataaagaatattctttctatattaaaagagaaaaataaagctatcaacgaactctaatatgagcgtatattaattgttagttagtcagcatgttagcatgaccttttcgtaataaaacgctaatatgaaaattagccaacaatatcggtacagcgagaggtgtgtaatgtgttggaaaataggctattgcgttttttttgtcgctatagtcggagaaagaataatctttccgctgatgttttgttaactttgtatgaataaaccgcgctataaccaaatgtcgggtaaatgtcgggtgaaagttcgctgctttatttgttgaatgtttgagttatgcataatcttgtcgaaaatttgaatgaagatgaaacagccggaattaggtaagtacattgcagggcttcgggaaacgaaagggttgacccaagaggaactggtaagtagatgtaatattagtgtccgaactttgcaacgtatcgagtcaggtaaagtggtaccaagaagttacacattgaggctaattgctactgcactggattgtgatttgttagctgttccggaggttcaggaaattggtaaagctgaactcccggttcatttgtcattcaaatctgttttgaaagatttgtttaacttaaaagtacacacaatggcaaaattatcagttttaacaacggcatgtctggctataggtttcagtttgtatactgtcggttccaaatgtaacgcacagcaaatgatgaaaatgaattttgtaacagacaataccggaggatttgaggtacaacttcctcgcggactccccggttatggaagttatataaataatgataccgtttttatcagggcgggggaagatttgatcaaagagcataaaggatctttgtttctgaataatgcttttgttggccatgtacaggaaagtgatacgataatatttaaaaagggaaacctatttactaaaaagtcacttattattaagccatatagaatgaacgcttctttgatatacaaagatattgtttttgtgacccctcaacctatcagtggttttactgatgataatggagacactttccgatcggggcctcatacttttaaagaaagggataatcgaatatatctgaatgatgtttatcagggggatgcttttgcaggtgatactgttgttttatccagatcaggtaaattagagattagacgaagtgtccaggagaaattagatatataatgaatataggtggtgttagtaaaataccgacaccacctatgttttatacgtgttgtttagagttgttaaatgccttcattctctatgagtttccctttaaagtcaaattttagttcttctccgtttgttaacacgatttggtagccataatctactacagtttcaacttttgttattttttcttttgcgttaattaccatatattgatttatttcatcaggcaaaacacttaaaagggcctccggaaatggatggccattcccgttaattgtaagccattgataatatttgttcatagtaataacgaatccattaggaagctcaatcttgaaaatcagtttagtgtaatcgtctggagtactgacttttttggatgtgataccaacaaaatatttatttataaactcatctatctaatctaattcaatagttatatgttctttctccggatcaattactacctggagtgttttgctaacccggatagtgtattgcgtagaatgagctagcaagattgccgttatttgagcttctgggtaacggcttgtgagatactcttttacctttgtaggtaaggattctataatggaagtcggtaatagttttccataaccgtcaagttctttccaattattattaatatcaaattccagtttaatgtttccatttaaccaaactatgtaattataatcagtatcctcattgatggaggtgttttttattatggtctgatactttgcttctggaaaatgatgagatatgaattgttttattgatgtaggtagttcatccaggctgtttatatccagtgtttctcccaggaatatacattgatatgtctgaaatgcaagttccttgttgctttgtaatgtaaatatattaccgaaaaaagtaggggtgattcctattataggatcattggggtaatttttccgaatgtattcactctcttctcctgaaaaaaatagatttaatgatcccggaaatgtgctgtttggagaagtaatatttaaccaatctccgatttgattaaacgtaatactgagatcgtcctggaaatagactttgtagttatctccattttccggatcggtagaagttattttctctattttggaaggagattgatcgggaagatgataagttaagaaattctgtgcttcaatcggcaattgctttgtttttaaattctcatcatcatcatttgaacatccgccgaaaaaagtaatacagaagagcgatagaagtaaacactgtatagatatcgatcttttcatggccttagagtttaatattaatattacaaatgtagtcaaataataagccgggaataaattgggtatgttaaatctgactaaataaattgcacgtttggcaaatgaattgcagaataagatgtgaaattgaatttgtcagaatgttatttgggtaaaagaggtaatacgtatataaattcactacatttacacgtcattatttgtcggcaataataaagtgacaaaacgacgacctgctcctgttaattgataatatctaatttgaagtgaagatacatatggatacggaatttataaacttaacaacggacaatcttgcagatgagcatttgtgttgcattatccgtactaaaaagctccatcccggtgttgaggcaaagcggcaatggctttctgaccggctgaatgaaggccatgtctttagaaagttaaatgcaaaggttacggttttcatagagtatgcccctttggaaacagcctgggttcctataacgggtgataactattattatatctattgcttatggattttgggtagttacaaagggaaagggtatgggaaatcgctgatggagtattgtatagccgatgccaaaaaaaagggtaaatccggtatttgtatgcttggagcaaaaaaacaaaaatcctggctttccgaccagtcgtttgcaaagaagttcggctttgaggctgttgatgttaccgataatggatatgaattgctggcactctcttttgacggaacaaagccgacgtttgcgcaaaatgtcaggaaacaaatgattgaaagtaaagaactgacaatttattatgatatgcagtgtccttatatcgatcaaaaaatcggaattgtcagacagtattgtgaaatgaatgatgttcctgtatctttcatccaagtggatacgctgcaaaaagccaaggagctaccttgcgttttcaacaactgggcagtgttttataaaggacattttgagacggtgaatttattacaggatgtcgccagcttaatgagaatactcaaaaagtaaaaacgtaattcctgcttttccctgttgattattacctctattgtgtatgtgatttataaataaacaacagatatggcaactgtaagattcggatatactccaacccatcccggcgaagtgctgaaggacgaaatagaataccgtaagatttcacaacggaagctggcagagcaaatgggcatctcctataaagctctcaacgacctgctgaacggacggcgcacgctgaccatcatcacggctatgatgtttgaggcggcattggatatacccgccgattcactgatgcggctgcaactgaaatacaatatgcagcaagcgatgggtgaccagaccctaatggagcgtttgaaccagatacgcaaatacgccgccctgctgtaaggctttggtgtacggaagaaactttcatcgggaatgctaaggggtgatcggttttttatacaaaaaaataaggtttagaccgaagaataaactccaggtaacttcttggatgaatgtatttcatttctcctttacgacttggtgtttatattcatacatggagattgtcgtagtgtttgaatatgagcatgaagtcggaacacacttattccgcttttgggtgggatgatagaaaaaagggactgtccctactcctgctcccactggcaaaaagcggacagaaaatatcccgaaccgaaggatgggcactgatagtaatgtatttctgttacctgccctagttgctcagggatctaaaagcaggactctttgaaggtcttgcttttttatacctttgtggctttcatacatattattttaaacgatcagcatgagaaagttttttacccagacgttggatagcttccagctgttctttgacaggagccattccgtccttattcaacttgatactgtcgagccccattgcatacaacatgccgattttctgggcgacacttccggcttcctgcgtaattgttcctgattatcttcatttagctggtcgaatgttccaaagcgtgaatactccggttttagaggattgttctttatccatcctccacaggcatactcataaaaatcagtaccgggagctactgttgtgtccagatttgccagcttgatagcgtccacttttgcagtttccttcacaggtgatttactgtaccccgccattgccatcataccgacagcaaccaatggaattactattaacttcttaatttttgttcaacgtttacttgaattatgccgcaaaggtacataaattcagataaatagaaccgattttagcctaatatgacagggtaaccgcaccaaaataattttactcagatggaaccttgtatatcaggattcacatccatatctttataaactcctatctatcggcaatttatataaagattttgaattgaagtggaagaccgacttttacctgatcggagtaaggaattccacaatcgcctcttgtctgcttgaacagatgtttccgactttgtcgcaaaaaagatcttcttatctgtcaggagtcacaacaggtgcttcacccgtcaaatatgcagaagctttataaccagtttttttagccaaatatctacaaaaatccgacaaaaaacacatttgcatattcggtatcttttctatttttggacattccaaagaataagaaaaatacacatatgcaaaaacaacggatggagtcgcgtaaactatatctaatcatccttcaggacatcatgaatggaggcgagatcattttccaaatgacttccacccctacaaaaaaggctgttcacgggagaagaaaagtcgtattcactgatacaataaatatatacacatatgaaatcacttacaattaactatctttcaattcttttatgtgtacaggtattttttgcctgtacatcccatgtaaaaaaatctcccgaacggaagtttaggatcatccataataacgatggtacagacttgttgggaaaccgttggttcaaataccgtccgctaacgcttgccgacctcgactccagtgtcgatatggttgcaaactcgcaggtaacaacctacatgatgtgttccggcagcgactttttttatgtccggtccaaatatgggcacgtgattggagacgacctgaacgggacactagattgcggttgcgatacggctcaatataactccttccgtaaatactaccaaaaccacttgaacctggaaaaagaagggacagatatcattgcccatactttaaaaagagcgaaagaaaaaggaatggaaacatttatcacctatcggatgaacgacctgcatttcaatgatacgactacccattgtccgatctggtacaccgacttctggattcagcatccggaatactggctgaacgacacgacgcaaggttataacagcggcggagcctttgactttgccataaaggaagtgcgtgaccgcaagctggcgattatttccgaacaattagagaactatgccgacataatcgacggatacgacctcgactttatgcgttttatcgtttacttccaatctgggacgggaccacagaacgcaccgcttatgacacaattagtaaaagatatccgtcaaaaggtagatgaagtttcggccaagcagggcagaaagattttactatccgcacgtgtagcaccgacagtcgagcaaaacatgatgaaaggattggatatacgtgaatggctacgcctcggactgctggactttatcagtacaggtgtccattggaggggagatcccgcaatgccggtagccaagttccgggaagagattgggaaagacctcaatattccgttctacagttctattgacgacgggggataccgcccacgggaattctggtcacacgggatgcacaggggtatgtgttctcacattctctcgcagggggcagatggaatctatctgtttaattattattttggcgcatttaattccgaacatgacgggaaactatacctggaagatggtggtcaagtttgccggatcatgatgccggaactacttcaagaattaggatcactggaaacactgaaaggacgtaacaaaatctatgctttgtcggatggcgttgtccagtacaatataaaacccgattctcctctccctctaaaaataaggaaaggagatcaaaaagaagcggatatttatataggcgatactgtagaagaaggctatccggaagaagcaatcctatttattcgtactaatcatccgattgcttgccggttgacagtaaacggggaaacagttaaaaaagaaatgccggcctacacccgcctttacgacagggaacgtggtttggatggggaagaaaaagaatatgcctttatcctgccagacaaaatcctcaagcaaggatataaccgcatcggatttcgctccgaagacgaaaatacgttcactgttaaacggatagagatagccctcaaatacggagacgtaaaaacgcacggatatttctaaagccatctttatcacaaagaaaaatcataaaaggttagtaataaaacaccggttaaaatcattggacaaataaacgtaagttttatagtacaagggaatgtgtcataattcgttacattcccttttataaaatcctagctaaaaggaaagaaggtgtcaaaatgataatggataatgttaaaaagtgagggatgtatttgttcatattacttatttttgtccggtcaaataaagattttgaaaggaaatgaagaaaaaagtatataaggtaatcatttgcctttgttgtgttgcgacgtctctctcagcccaggattatgtagtcgaattgacaaatccagatgaaagttgtacaagtatcgctgtaggtaaattggcgacgaccgatggttcggtaatgacctcccagacttgtgacggaacctcgcgtacttggatggaagtagtgcctgcacagaactggccggatacggcaaaactcgatatctactgggatctacgccacacggaaagcaaaaacgaccgtttgggagttaaactgaaaggttctattccgcaggtctcttatacgtttgctttcctgaatactggttatccttgcatgaatgagaaacaattggcgatgggcgagacaactatcgttggacgtaaggaactacgcaatccgaatggtttgtttcatatcgaggatttgcaggggattgctttgcagcgttgcagtacggcacgtgaagctgttttgctgatggggcgtttagcggagcaatacggctattgtgacggtggggaatgcctgacggttgccgataaaaaggaactttggtttttcgagattacaggtgcggggccgaaagatatgggagctttgtgggttgcccaacgcataccggacgaccatgtgacggtttcggccaatacgcctcgtatttccgatgtcgatttcaaggataaggataattttatgtatagcgagagattgaaagagaaggctcgtcaattaggatattgggatgggatagaacctttcaagttttggaaggttatccatgaaacggggaagaagccttttactatccgcgacttttttgttttgaaaacgctagctccttctttgaacctgacgatggatatgggggagcttcctttatctgtcaagcccgaacggaaaatctctttgacggatatgaaccgtctgttgcgtgaaacgtatgagggaacggagtgggacatgactaaagatatgatggtaacgaagaagatcaaagataaagacgggaccgaacgcgatacgacgtataaaagcccgttggctcaaaactggatgacaaacgacatgtttgagtttttgaatgcgcaacgaggtgaaaaaaagatagagaaacagcggacgatatcggttgtttggtgtgcttattcgtttgtaatccagtgccgtgattggttgcccgatgaggtgggaggcgtttgctggtggtcggaagataatccgggcgagagcccacgtgtcccgttgtttgccgggatgacggatgttcctgagagttttaaggtatgcgggcataagcactatcgccttgatgcggctctttggacttaccgtcgtacaaaccgtttggcacaggtgagctgggggcatggccgcaaattgattgaaccagccgttatctccttcgagcggaaagctgcagatgaaatgcctttagttgaggacaaggtctcggttcttattcgggaaggcaaaaaggaggaagcccaagcatatcttacccgttactctttcgagtttatttactcgactcttcgttgctgggaggagatggaaggacaactttggcataagttcgggagaggattttgattgatcctctcctatttttattttaggctatagatttttgtccctttgtatcttaacatgttttctatatgagatggggcttacgcctgttttttttcggaagaagaaagaaaaataatctggagattcgaaattcagtttggcagaaatgtcttggatggacatttccgtactgtctaacaattctttgattttgttaattttcaattgtaagatgtattggtgtggggtaatccctacatatttcttaaaaaattttctaaaattggagtagctcatgtttattgctttggcaatgtcttccgatgtgaaattttcataaacgttttcccgcatcagcatacaggctttttgcattttttgtatggcttccgtcccatagtcttgggttttatttattgaataaattaagctgataatgtgtaaagcggttccgccgagtaacacttggaaagcaggtttttctgccatggcagaatcaatcatttcattcaaatgattgattaataatctatttataccaatatgaaatatcggatttgtgtagtttactatttttcgtaacagattatcaaaatagggtccgctaagggtgaagtaatattcgtcccatccgatctctgctatcggatgatgggtgtgccattgtttgggaaaaatgaaaaaaacatccccttcggatattttggacatgggacagtttgaagatatgaaaattccttctcccctggttacgtacactaatacaaattcatcgataatccttcctttttcaggattgaaggtgtatttggctgaatgtccttttaaaggataattttcgttgggcctgatagattggaaacctatgctgctgatagaaattccccatgttgtttcgttgtcgtttgtgggcaagtacttgataatgttgtgtttgttgcgattggaatacataagtatatattgtttgagattctttcccagcctgtttttccatagatagaaacaattttcgcaaatataaaaaaaatatcatttaggacaaaattatacaaaaaaatatcatatttccatgtagatgcagaagcagaatctggatttttgcagtaaattttgttaaacaaaaataatatatgaatttatgaaagatcgtattctgcttttgctatgttttctactgtgtgggatacaagcttttgcccagatttcagtatcgggaaaagtggtggatgccggtagttttgaattgccgggagtaaacatttccgtgaagggacagacgatcggcactatgactggtgccgatggtacgtttacgctccctggtgttccggggagtaattctgtgttggttttttcttatgtcggatttaagacacaagaagtgacagttggtaatcagcgaatgatcaatgtcacgttattggaagattctgaacaactggaagaggttgttgtggttggttacggaacggcacgtaagaaagatgtgtcgggagctatttccaatgtgaaattttctgatagtgatattaccgctttacctaatccgaatgcgattgctgcgttgtcaagtaaagtggctggtttgaaatatgctccgacaagcagtgctggtgctaataatatggggactatgactttgcgtggtaagaatgcaattccggcagatgtttcttctgacaagcaaagtgtgaatcagcctttgcttattgttgatggcgtcatttcttttggtggtattaatgagatcaataccaatgatgtccagagtattgatgtgttgaaagatgcttcggctgctgcaatttatggatctcgtgcagcgaatggtgtaatcattattacgactaagaaaggtagaagtgaaacgccgactatcaatgttaatacgaactggagcttttcggattggacacgtcagcctaaaatggtatctgatgaagagaagttcatgaaaaatcgtttttattcaaaacaagcgacaggtagtattccgggagatgctgtatggtctacttcttatgataaagcgcaattgttgaatacggttgagttagatgcttataacgaaggtgtttatgcggattggatcgatgaaacctcacgtgtcggtgttggccagaaatatgatgtgagtgttgctggtaactcaaaggtggtaaattattatatttctggggattattaccgccagcaaggtattatgaaaggaaatgattatgaaaagtataacattctttccaaattagatatcaaggcaaaagaatggttgactttcggtttgaagggtaattttttgagttcgaagagttggggggtctctcctcgtattcagaatgcaacttggatgtcaccttattcgtatattcatgcgcgtcagccgggatatgaaaactggtataattcgaaaccggatggaaatgttgctagtccttattggggaaccggttcaaacgactcttatttatggacggacaaagaggatcatggattcaatatcaatggtgtattctatgcacaagtggatttcccctttgtaaaaggattatcttatcgtatttctttgaatggacagcgtaatacaggaacaagtgacctgttcaataatcccggaatgtgggtagatactgataatacggcgcaaatggatgatccttcgcagtttggatccagagccggaggatattcttattcttctattagcggcacttggaatgttgataacattttaacctatatgaaagatctaggtaaacatcatttcgatttgatggctggttatactcgtgaggcctctaataatgagtatctcagaactgatttctcgaacttctctgttccgacaatcttaggtgtctataaacaagatttggcttcgacgaagacactcagacgtgaacgtacacagagttctgctctagcttatttaggtcgtgttaattacaattacaaaaacacttactatgcaactttcaattttcgccgtgatggttattctgcatttgcggcagggcataagtatggtaatttctatggagcatctgctgcttgggtgatgagtaatgagaatttcttaaaaaacaatgtggactggctggatttcttgaaacttcgtttctcttggggacagaacggtagccgttcggtgagtccgtatgcaactgtagcgacagtcggtacgacttatacttggtttggtgatacaggttccggtagtgcatttggcctgacaccctcttcattgccgaaccgttctttgacatgggcaactgttgaaaaatataatttaggagttgatttcggtgttttgaacggacgtttgaatggaaatgtagatttgtatgtaggaaatacaacggatatgttgatgaatcgttccgttccttatcctactggtttccagtctgctagcgataatgtcggaaaagtaacgaacaagggtattgaaattacattgaattccgtaaatatcgatggggacggaaaagaaaaattccgttggacttccgacttggtgtttgaccttaaccgcaacaagataaagagtttgtatggaaaagattatgagggtaaagaagctgacgatgttgcaaatgctgtagcctatggctttgataactattatgccctgatgatcggacatgctatcggttcggcatacgacttgaagaaggttggtattttccaaagccaggaagaaatcgacaattataactggacgaatccggaaacaggtgaggtaagcaaaattcaacccgatgccgttcctggtgatttgaaattccttgattataataacgatggtaagatttccggagatgaccgtcattggatcggcgacatggatccgttgtttacagttaattttggtaacacgttgagttataaaaatttttctttgtatttcaacttccgctggatgcagggtaacgatacccactttttaggatatgatccgaatgctttcggaacgaatatgtccaacggtgctcagttggatgctgttaacccgtggactgccgataaccattccgacaaatatccgcgttacggatatagtaattcgttgaactatttgtattggaactcacggacatttttgaaattgaaagacttggtgttctcttataatgtcgatgcgtcgttcttaaaaaagctggacatctcttctttacgcatttatctttctgcaacggacttgtttaccatcactggttggtcagggcttgatccggaaaacggaggtacgattgcttctaatgcttcttcgagccgttatggtagtaatggtacttacaagacagtttctgtaggacttaatttatctttctaataataatatacccaaaagaagtaaatatgaaactcaaaagatatttattaatagcattggccggaacctctttggtgaccggtttcacagggtgtcaaagtgcggatgagtttttgacggaacattcttataaatttgacgaccaaactttttatacttctcaggctgatatggaaatggggttaaatgcttgttatcgccaaatacaatcattgatgatggggcagacgcatggcggacattcttggatgatcatgggattgggacttgatacattcggccagacaggaggtaattctcaatttgcgaactggaacaacttgaatgccagcgacggtttgattcgtcactggtatgacaaactgtatgatttgattaaccgtgctaatacggttattgatatgatggacgaacgcgactatattacatattcttcagctgaaaaaaaagcacaacttcgtgcaacggctgtctttttcagaggttgggcatatcgtgtattggcaggtatgtatggcaatgtccccatattggatcatcgcgtaacgagtattacgacaggttatgttccaactactcggcaagatgtatgggaattctgtaaggacgactttacttatgcggtgcagaatttaccgataaaagctgaaaaaacgggacaaattgttcgtgcagctgccgaccattatctggcggaggtaagtctggctttgggagattttagcggtgcagtagatgcctcttctcgcgtgattgacggaaccgatggcgatttccatgtcatgacaacccgtttcggctcccgtgcaagcgaagcgacagatcgttatggtaactctttggctgcacctgccggtgcttactgggatttgttccgtgaaggtggcaatcaaaactcagaagacaataaagaggctatttgggtgtgccaatataattacaatacttattctactggtggtggaggtaacgaatggtatcgtatttatgcttgtacgactgaatccaactggctaagtaacacagttcgtctcaataaagacagaagaatagcggacgatggtacggagttttatttatggggtgacaatactgcttgtttccaagaaggaatcgtcggaagtgctctttctaccgtgccttcggccaaaggacgttatgaggccgatatcatgcgtgactcaattggtggcaatgttccttacagtggcaatgtcctgtggcctacaagatatgtctataccgatttatggaacaattccaaaaaggaaggcaaggaagatttccgtggttctgagatcatgattcagcgtaactggtacactccgggtggtacgcgctggcttgatgagaaagctgctgcatttgaaagagcaaaggcttacggatatgtgatttcggctgctgatacaatcagtattttcccgcgtttctggaaattctcggatgataaacatcccaatggtgacaataaggcatacgactgcgactggtatatgactcgtgttgcagaaacccatttgctccgtgccgaagcctacctggctttgggtgaccgtgcaaaagctgctgacgacatcaatgtcctgcgtaatcgtgccaatgctccgctttgtacggctgccgatgttaatattgattatatcctggatgaacgtactcgcgaattgttgggtgaggaacagcgttggattacattgaaccgtttgtctgtgaatccgaatgcgacttatgtaacggaggtttatcctgttcaggatgaaaaaacgtccaatacgctttatgagcgtgtgcgtaaatatggtctcggctatgaaaatatgtccggttctgaccagccgcgcgaatggagcgaagcggagcgtcgttacatatcgaacattcatccatataattatcaatatccgattcctatacaggttatccaatctaatacgggagccgagtatcctcagaattatggttattaatataatgtagtttaattgtagaaaggatggccaattagactgtcctttcttgtctttttatgatgaactgctattattaaatgtatggaaatacactttctgttaacaagtcaaatatgaaatagaattaagatggctgttttttcgagctcgtttaaagctatgaattcccgatatagaaatactttatttagtggaatctgtgtgttatttttctttgtgttaggatattatctcaaagaaacccagcaatatgctttgttctaccgggagcaacaacaactgtttctatttgattgggcttatatttccgatattcttaggcaacccggaggcctttctgttttaatgagcaggttcatcgtacaattcttttattcgctttggactagtgctattttgacatcgtttcttttgactttaatatctttattaatctggctcgttattcgcaagataggaaattatcgattccttttgcctgtttgttttatcccctgtttgttcttggctatttcattacttgataattgttttcattatgaaggtataactgcctattttttaatgcaactgtttttgtttgtatatagtattttaggcattaaagaaaataaatggcttcgattgtctgccggatgcatgtttattgttgcattgttttatgcagcaggagccgttgtactcctatttgccatctgtacttttttgtatgattgcttgatgaggcgggagacagctttgctgtcccttctgtatattgctttggcgcttattgtaggttttgtcgctgtgcaattcggttgggctggtttatatgcttatgtatataccccgttgggttactatgaaacaactgttacggctccgtttgtccattatgccgcttggttggcactaccggtttgcttattggttgcaggtgccatccgtttttttgaaagaagggggcgcaacagccaaatcgccattggattgatggtgattgttgccggattcgtttgtttacagaagaattatcaggaccatataaaaccggatcttaatgatttttatcgatatgaatattatacggtaaatgagaaatggaatgagttgctcaaagcaagcgcaatacgtatcagaaatcacaatgatgcgaactatttgaatctttctctggttcaaaagggagaacttatcgagcatttattccattatcctcagtttggacctaaatctcttatttatatacctaaagataaaacttcggatgtcaggctggctcatgtgttgtttgcaatgggaaatatgggagctgcccagaatgtggcatttaatgccagtttgtcgttgaacggctataatccgactatgttgaaaatggtcttgcaaatcgatttgatgcgtggggcttatgctgttgccctaaagtatatcgaattgttggagaaaacttggcattattccgaatgggcgacatctcaaaggaaatttctgtttgacgatcgtgcggtggagcaggatgctgttttagggactggaagaagagatttccctaatgaagaaacttttgtattgtttaattcccctatggatgacttgtacaaaatccttgatgctaatcctgttgatgggaaagcgatacaatatgccctatcttatttattgttggcaaaggatattaatcatgtcaaagagtttattgatgaatattacggaacgctggagttaaaaactttaccggtttctgcacaggaagctttgattttttattatgattattatcatacattggatgaaaattatgcagtgcagcatggaatcacgaaagagcaattgcttgtttatcaaagtgtggatttaaactattgtaaagagcatggagtaacgcaagatacgattgacaggtttgcaatctttaaggaggcatatggtagggctcggcaatctgcagatgctttggttgcttataaaaacactttctggtattatttactttttgtacaaatataaatatgaaaaatatctatcaattcatgtggggattaagcgtggtgttctgttgcatagcgtgtggaaaggtcaatgtacggatatcagaagagttggaagagagtccttcgatatttcctgattataaagatgtaactgtcccttataatatcgctcctctgaatttctcttatatggggaaagaagagtgttgtctgattgttgcagggatggatggagaaattcaagtaccaggcgtaaaaggacttttctctttctccgtttctgcatggaaggatttgatggagcgtaataaaggtaaggtgttaaagctgactgttgccattcgttcgggcgatgaatgggttggttataaacctttttgtatagatgtagcatcggaaccgattgatgcttatctttcgtatcggctgattcctcccggatatgaaggctggaaggatatggggatttatcagcgcaacttagagaactatgaacagactgccatctatgaaaataagttgacagacggcaattgtgtgaattgccattcttattgtaatcggaatccggacaggatgttgtttcatgcaagggccgattttgatggaactgtcatgatgcatgatcgagtgatcgagaagttgaatacgaaaactgattcgacaataagtactttggtctaccctttttggcatccttccgggctttatgtggcattttcggttaacaagacaaaacagagtttttttaacagtcattcgaaccgggtggaagtctatgattcggcttcggatgtcgtagtctataacgtacatactcatcagatcacttattctccgctaacgaaatcggctgaggcctttgaaacttttcctgcgttttctccagatggccggagtttgtatttctgctcggctcacgctgtcgattccatgcctcaaaagtataaggaagtgaaatatagtctttgccgtatagcctttgccccggaaaatatgacgtttggcaatcaggcggatactttgtataatgcatctttacatggaaaaagcgtttcttttccacgaatatctcctgatggtagatttctggcatttgttttgcatgaatttggtaatttttccatatggcataaagatgcagatctatatatggtcgatctgcaaacacaagaagtctatcctctgtctgaagcgaattcgaatgatgtggatagctaccactcgtggagtgataacagccgttggatggtgtttagcagcagacggattgatggattgtatacaaggccttttattgtctatatagatgaaaatgggcatgcgcgtaaaccgtttttacttccacaaaaaaatccgtcgatttattataagcggctaatgttctcctataatatcccggaattgatggtgaaaagagtagatgtgaggaagcataagattgcaaatctattgaggaattctgtcgggatagatgttatttctgatccaattatgccaaatttttaattataaatatcaaaagcatagataaaatttgtgagaacgtaaatatttttgtccgttgtgaaagacacatggaatatgcattaatcttatttatgtaaataccgtattatgatgaacagatacaaattctttattctttgcctcagcctgatatgcgaggtaagcctgtcagcaaaagattattatgccacggatttcggagtgaaagcggatggtaagactttgaatacgaactctattcagaaagggatcgattttgtgaatgagcaggggggaggacgtttgatttttactgcgggtaattatcaaactggtactatttacttgaaatcgaatgtgacgctccaccttgaggagggggcgactttacagggatcgactaatccctgggattacgaaaaagatccgtatattcgttggatgtctatgatttttgctgttaaacagcagaatatcggtataacgggaaaggggacgattaacgggcgtggttttcaaaccgccaacaatatggtggactatatccggcgaggtatttacgaagaccctctgaaactgggccgtccgaacgagacgaaccgtccgcagaacatctattttcgtgaatgtgagaatgtgacgatcaaagacatcactttgcgggacccggcaagctggaaccaaacctatgatcaatgcaagaatctgtatgtcgatggcatacacgtcgatagcaaatcttactggaataatgatggcatcgatgttgtggattgtgatggcgtcgtattgaaaaactcttttcttgatgcggcagatgatgctctttgtttcaaatcgcacgatgcgaatagcatgtgccagaatgtggtcgtcgagaattgcgtaggccgttcgagtgccagcggattgaaattcggaacagtgtcccgtggtggtttccgtaattttaaagtgaagaatattaagatatatgatacgtatcgttcggctataacatttgctgcggtcgacggtgccctgatcgagaatatcgaagtggatggtgtgcgctccatccatacaggaaatgtgatctaccttcgtattggtgaccgttggagtgcagggaagaagccggttatgaaaaatataaagatcaagaatgtctatgccgagatcccgatggataaaccggatgccggatataactatgagggaccgatcgaagacctccctcgtaatatttcgccagccagtatcatcgggttgccggaatataagattcagaacgtaacgcttcaaaatattaagatcgtttctcctggaggcggtaatccttactatgcttaccggggactgacaccggctgaattggacagtatccctgaaatggaaacttcttatccggagttttcgcagtttaaggaactgccggcctgggggttctatatccgtcatgccgaggggattacttttgataatgtgacttttatggccttgaaaaaagattatcgtccggcggtcgtaatggatgatgcagggaaggtaacgtttaaagatgttcggtttgtggagccggaaagcgagggaaaggaacagatatttccttataagtctaaagtaataaaatgatagtgtgataccggaaaaggaatttgtgggattaaaataaaagagagacaatatgaataaaaataaattatttgcaagtgtgataggtcttctggtcttcgtgtcgaatcttttggcaaaggattatcaagtcgcgatgtttgggatcaaatcggacggggtgacactcaatacccgttccatccagcgggctgttgattatatcagcgaacaaggaggcggtcgacttatcttttatgtaggtcgttatctgactggttcgatcgagttgaagtcgaatgtgacgattcgtatcgaagaaggggctgccttggttgctgtcccatccgtttatgattttaaaggggtagggggacgtaacgcgctcatttacgcagacaagcaaaaaaatatcggtatcggtggtaaaggaattattgatggtcgtagtgttactgtactggcaagcgtggaagagcaattgcagaaaggccatatcaaagctaatatttctggttatgctccggctttgatttgtatggaaggttgcgaggatgtgaaaattgagcagatcactttgcaggatgctgctgatattgctgaaatatacaaggattgtcgcaatgtaacagtcgacaaagtcgttgtgaacgcaggaatgtcgaaacggaaagcgatctcaatttccggctgtgacggagtaaagatgacggactgctattttaatatgacagggaatccgctggaaagtacaggaacatcacgcaatttgatatttataaattgtataacattagacggcaaagctgtctcaagcgatcaataaaaggaggaaaaaatatgcagaggagatcttttatcaaacagagtgttttatggacagctggttgtgtcgttggtaaccgtatgccgctatggggggcagtcgatgcaaccgaagagatggcggatacgaccttgcgttccggtgagctatataagttattccgtgatccgcaacccatttaccgtccgtttgtccgttggtggtggaatggggataaggtagaggctaatgagttgaaacgtgaattacatgtattgaaggaggttggcatcggaggggtggagatcaatccggtcaaattccctggcaatgacacggatgatctgggaaagaagtctctgccctggctgagtgacgaatggattgatatgttgcgggtgactttcgacgaggcgaagtcgctagatatgaattgcgacttgattgttggttccggttggccgttcgggggcgaattcctgacgggcgatgaaagggcggatcttgtcgtgaactattcccgaaagttgatcggaccgattgactatgaagtctctcgcgacggattgttcagtacggcggaccccgccataagttcgccgtttttgggtaggaagatggagttactctcccttcaattggttcccgaaccgttcggaggtcttgaccaggttatcgatctgatggatagagagagcgatggaacgtttaagtttcaggttcccgatggtaaatatgtcttatttgctcttgtcaagatacagggtttccttgaggtgattaatggcgctccgggtgctactggtccggtgttgaaccattacaataagtcggccgtacagaaatatctgaacaatatgtcggataagattcaggaacgcttaggtccgttgtccggtaatatccgttccctgttcaccgacagcatggagttggaaggttcgaactggtcctatgacatggcggaagaattcaagaaacgccggggctatgatgtgcaaccctacctacctttcattctttttaagatgggaagtatggggaatgcattgacttacgagccgaaggtgcaatttactccagagttgaacgatactattcagcgcgtacgctatgatttcgaatatacgaaggccgagttgctccatgagcgttttacgcggacttatctggactggtgcaaggggcttaacgtcaaatcgcgtgcacaagcctatggtcgggggctatttccactcgaaagcagtctggattacgatattcccgaatgcgagtcttggacgatgacctggctgcgtcaccgtttgggagaagaaatgtcggaagaggactatcgtcgtgggcgtgcttatacgatggtcaataaatacgtttcttcggctgctcatctgcgcgggaagcgtctggtgagttgcgaggagatgacaaatacctataccgtgtttaacatgacattggagttgttgaagatcggaggcgaccagacggctatttccggggtgacgcattccatcttccacggtttcaactattctccgaaggaagctccgttccccggatggattcgctacggggcctactataacgagaataacaattggtggccgtatttcaaatattataccgcttataaaggccgtatggcttctgccctgcaacatggaaccatgtatgcggatatcgcaatactgaatccgatagccgatatgtggagtacgttggggatgcagaacgagccgtttccttctaccaccaacgtgatatataagacattggtatgggaggcaatccataagaacggtagtggttgcgactatgtttccgaatcaatcatcagggatgccgagatgaaagagggttgcttgtgttacggtccccgcaaatataaaacgcttttcctgatcgaagtggagagtatggaaccggctaccgcccgcaaactgtatgattttgtggcttcgggcggacgtatcttctgtattgaggcttatccgtataaatcagtcggcttgaaagatcatgacaagcacgataaggaagtacaggaatgggtggaaaagatgaagctgatggaagaacgtttcgtattgctacataaaccggaaaaggattttgtcggttggtatcaaggagtacagaaagactatcatctgataccgtatataacaattgaaaagcctgattcttatctgatgcagaaccgttatcagggcgataacagggaagaaatgttcttcttcagttatgcacaccgttataattcgcatcagacccatatctccttcagcagcgagatcataaaaggtcggcagggttgggtgtgggatctggaaacgggtgaacgttatcggttgccgttagatgccgacaatggcttcctgtttgatttcggtccggcggattctctcctgattgtgttcgataaacaaaagagaggaaatgactataagccgttgcccgtttccggggcggatttgaaagatctttcgtccgactgggatatagagttccgccatagccgtgagaatacagtgcagaatgctcatttcgacaaactgaaagatttgaaggaaacggactttgttaacttctgcggaacaattgtctataggaaaaaaattaatgtttcttcgcctaccggtacggtgcttaacctcggattggtacatggtgtatcggaagtatttgtgaacggacagaactgtggtgtcaaatggtatggccgccgtatccatccgattgctgcccaattgaaacagggagaaaatacgattgaaatacatgtagtcaccgtaatgggtaactatttgaagacgttgaaggataataagatcgcccaggcgtggacccggagacaggatgttgtccagtcggcgggattggtcggaccggtcaccacttatagaattaagaattaaaaattggagatttaaagatattatgaatgtaattagaaaaataacgatcatgtgtttgttggcgggaatgatgattccggtatgggcgaaggattatcagatgaccatgttcgggatcaagtcagatggaataaccatgaatacccgctccatacagaaggctatcgactttatttcagagaacgggggcggacgtttggtgtttactgttgggcgttatctgactggtagtattcatctgaagtcgaatgtgacgatccatctgggagagggtgctgtgttggtcggttccaccaacccttatgattatgatatggaactgaatgcctggtatggtttgattctagcgaacaaacaggataatatcggtattaccggtaaaggtgtgatcgatggttgcggacgtgagcttgccaataacttcatcaaccaggtttattctggggtgattaaggacaagttgcagttggggcgtgttgccaaccgtccgaagctagtctatcttcgtgaatgcaagaatgtcgagataaaaggtgtgacgatgatgaatcctgctttctggacacagacctacgatcaatgtgagaacttgttgatcgacggtattatggtgcatagtcgtgcttactggaataacgacgggatggatattgtcgactgtaacggcgcattgattcaaaattgctatgttgatgcgacggacgatgcgatctgcttgaaatctcatagtgccgatgctgtttgccagaatatcgaggtacgcaacaatacggcctgttcaagtgctagcggtattaagtttggaacggcgtcgacgggtggtttcaagaatataaagatcattaacaatacgatattcgacacattccgctcggctataacgatccaggcggttgatggcggacaggttgaaaatgtcatagtggatagcctccgttccatcaataccggtaatccgatttatctggtggtgggggagcgccgtgaaggtcgtcgtagccggatggacaacgtccatatctcgaatgtctatgccgaagttccggcaacgaaaccagatgcaggatatgactacgaagggccgacagaagacaatccgcgtaatgtatcgccttccgctattgtcggattgcaggataacaagataacgaatgtctctatcgagaacgtcgagatcgtctatccgggtggtggtaatccgctgtatgctaaagtcggcttggatgaattggacaaggttccggaaatgcctaaggcttaccctgaattctctcagcataaggagttgccggcctggggattctatgttcgccatgccgacggtgttactttcaagaacgtgaaattgacaaccttgaagaaagattatcgtccggctattgttttagatgatgtgcacaacggtatgtttgcgaagatcaaagtggttgaaccgtctgccggaaagaaagaaaagatatacgcttacaagtcgacaaagatcaaaaagtaaaaatagaaacttacggaaattcgtaaaaagaggctgtgtcgtaaatgaagtgtaccctaaaagttatacaggtcaaacatttaccagttatagaaaggggccgtccaaaaagtcggatagccccttttgctattgtttatttcggtaaaaagcagtatcttaccgttgcaacaaacattatagcaatggctaagatagtatttaaagagttaacatccaaccaaaatgtactttttccggtaagtttatcggaaaagatagctcccaatcatcccgttcgtgttgtaaacagtgttgtagacacattggatattagcagtcttcttcagacatataaaggaggaggcaccagcagctaccatccccgtatgatgctcaaggttctgttttatgcgtacttgaacaatatctattcctgccgtaaaatagaaaaggccttggaggagaacattcacttcatgtggttatccggaaataatactcccgacttccgtacaatcaatgatttccgtagcaaacgtttaaaagaacacataaaatcgttgttttcagccattgttctgttgttacaagaatccggctatgtcagtttggatgtacagtatatcgatggcaccaaagtggaatcggcctccaaccgctacacttttgtctggcgtggcagcgtggaaaagaacaaggccaaactgaagtcgaaaatacaagcaatccttagtgagattgacaaacatatcgaacaggacaaacaggaaaggacacctgatgtcttaccggatatggattcctgtggtttacgggaaaaggtgagcgctttaaacaaacggctctccgggatgaataaggcagatcagaagcaagtccaaaagctacaggaagaatatctgccccgccttgccaaatatgaatcgcaattagagaaattagaggatcgtaattctttcagtaagacggatgaggacgcaaccttcatgcgcatgaaagaggatcatatgaaaaacgggcaattgaaacccgcctataacgtacagattgctacagaaaatcagtttattacaaacctggggatttataggcgtgccggagatacgggaactctaattccttttttgaatgattttcgagagacttatcataggcaatcttctatcgtagtggccgatgccggttatggaagcgaacaaaactacgaatttatggagaatgcgggtatagaggcttttgtcaagtacaattatttccacaaagagcagaagcgtgcctggaagaaggatgcttttgccatacagaacctttactataatcaggaacaggattactacgtatgcccgatgggacaatatatggaatatacaggccaaaggaaaaataaatccgatttgggatatgtatccgtactgaagcgttatcaggcacagaaatgtgagggttgcccgctgaaatctcaatgtcataaatcaaagactaaccggatcatagaagttaactataaccttaacaggcataaacaaaaagcacgggaaaaactcatgagtgaggaaggtatttatcatcggggcagacgatgtatagaaccggaagcagtctttgcacagataaagcataactcggcatggaaccggtttagattaagaggattggagaaggtaaaaacagagtttaccctagttgctattgcacataatctaaggaaactggctaaaaaagtcagttctcttttgttttttacttatttctgtaggataacttctcgaaaagagataattgagaaaaacaaagatggttttaatataaaaatggataataaaagagcggcataacaaaaaaagaaggcattcttttcagacaccttcttatttatgagtttatgacattgttatgtcttctgttttggcggtccggacgggactcgaacccgcgaccccatgcgtgacaggcatgtattctaaccagctgaactaccgaaccaaaacaaataaggaaataataattaaaagaagcggtccggacgggactcgaacccgcgaccccatgcgtgacaggcatgtattctaaccagctgaactaccgaacctctttttattatcaatctctctcgattgcggtgcaaaggtaagtattatttttaatcttgcaatacttcatgggaagaaaatgtgagttttttttaatcatacctgatatgcaggagattaagaattgaattttttttggctgttttcagaatgaccggagttcttcataaggcgatttaaaacaggtttgtcacatttacactctgtttggcaacttttcattaatcaaaggggaatatgttatgataatttgttacttttgcaactcaatataaaaacggaataaaaaatggacgtcgccattattaagtataatgccggaaatatttactcagtgagctatgcactgaaacgattgggcgtaagtcctgtgattacagccgatccggaattattgcataaagcggataaagtgatcttcccgggcgtaggagaagcattcactacaatggattatctgaaagagcataaactggatgctattatcaaggatctgaaacaacccgtactgggtatttgtctgggtatgcaattaatgtgtcgtcattctgaggaaggggatgcagactgcctggggattttcgatacggaagtgaaacgattcatacctcaccgtcatgaagacaaggttcctcacatgggatggaacacgatcacggaggttaaaggaggtttatttaccgcacaattggagaacaaatttgtttacttcgtacatagttattatgtaccggttaatgagtatacgactgcaaccactaattatattcttccgttcagcgcttcgttgcataaggataacttctatgcgacgcagtttcatccggaaaagagtggttctgtcggtgaagtgattctgaagaattttctaaaattataaagatatatgatcgagcttattccagctatagatttgattgacggcaaatgtgtacgtcttacgcaaggcgattacgacacgaagaaagtgtataacgaagatccgcttgaagtagcgaagatgttcgaagcacatggtatccgccgcctgcatgtggttgacctggatggagcacgtcagggacggatcataaactatcgtgtgctggagaaactggctacgcgtacttcgctgataattgatttcggaggcggactgaaacaggaagatgacctggagattgctttcgaaagcggggcacagatggtgacaggtggcagtattgccgtaaagaatccggaggtattcacatcgtggataaccaagttcggaagtgaaaagattatattgggtgctgatgcgaaggataaaaaaatagcgatcagcggatgggaagaaacaactaaagaggaactgataccttttatcggagggtattgcgacaaaggcatcaccaaagtgatctgtacggatatcagccgggatggaatgttgcagggaccggctatcgatttgtataaggaaatacgggatgcactaccttttatatatatcatagccagtggcggagtcagttctattgaagatatagaaaaattggctgaggcgggaataccggcggtaattttcggcaaggctatatacgaaggaaagatcgatttgaaggatctgcttcgttttacctgataattaagggagatcaaagtatgttggcgaagagaatagtaccctgtctggatattaaggatggaaaaacagtaaaaggaattaattttgtgaactttcgtgatgcgggagatcctgttgaactgggggcacaatacagccgggagggagccgatgagcttgtctacctggatataaccgcttcacacgaaggacgtaagacatttaccgaattggtgaagaaagtggccgcaaatatcagtattccgtttacggtaggtggcggtattaatgaattgaaagatgtggaccgcctgttgagtgccggagccgataaggtttcgatcaactcggcagcattacgcaatccctcgttgatcgaagagattgcgaagaatttcggaagccaggtctgtgtggtggctatcgatgccaatcaagagaacggcgactggatttgttacttgaacggggggcgtatcccgacggagaagcacctgtacgaatgggctatagaagcggaaaataggggagccggagaaatcctgttcaccagtatgacacacgacggcgtgaaagacggatatgccaacgacgcattatcggtattggccgataagctgcatattccggtcatagcctccgggggagccggaaagatgaaagactttcgtgatacatttgcagaagggaaagcggatgccgccttggctgccagcgtatttcatttcggtgagatagctatatccgatttaaaacaataccttcatgcggaaggtatcaatgtaagaatataatcattagaataagatgaaattagattttgaaaaaatgggcggacttatcccggcaatcgttcaggataacaataccaacaaagtattgatgctgggctttatgaatgaagaagcctatgaggaaacaaaggaaaccggtaaggttacttttttcagccgtacaaagaaccgtttgtggatgaaaggtgaaaccagcggcaacaccctgcaggtggtcagtatgatggtagattgcgataacgataccatccttatcaaagcgaatccggccggtccggtttgtcatacgggtgccgatacctgttttggcgaaaagaatatagaggatatcatgttcctgaaatatctgcaggactttatcgaacagcgccgtcaggaaatgccggaaggctcttacactacttccctgtttttgaaaggggtgaaccgtatggctcagaaagtaggcgaagaagctgtagaaacagtgatcgaagcaacaaacggaacagaagatggctttatctatgaagcatccgacctggtctaccacctgatcgtattacttacaagcaaaggcctccgtctggaagacctggcacgtgaattaaagaaaagacataaagcataaattactatggaagatacaattctgctcagactggaagatgtagagatctgccgcgatgaaaatgtcatactgcataatgcctcttttacgcttcgtaacggagagtttgtctatgtcatcggaaaagtgggttccgggaagagcagtctgttgaaatctttgtattgcgagatcccgatcggccagggagaagcctggctgatggattacaacctctgtaagatgaagcggaaagatataccttatcttcggcggaaactggggattgtttttcaggatttccaactgcttaccgaccgctcggtgatcaaaaacctggagttcgtcctgcgggctaccggatggaagaagaagagcgagataaaagagcgtatcgacgatgtgctccatcaggtcggcatgcataataaaggatacaaaatgccgcacgaattgtcgggtggcgaacaacagcgtatcgtcatagcaagagcactcctgaatgatccgaaactgatactggcggacgaaccgaccggtaatctcgacccggaaacaagcggccagatcgtacagcttctgcatgacatttgccagaaaggtacggcggtggtaatgaccacacataactatacactggtacataattatccggcccgtatagttaaatgtgagaatgcccgtctgagtgatgtgggagaatgattttttatgtaactttgcacacgcaaaatagcaaggaacaaacaatttaattataggaaaagaaaatgaaagttttaaagtttggcggtacttctgtgggatctgcacagagaatgaaagatgtagcaaaattgatttgctcaggcgaccgtgacattgtcgtattgtctgccatgtcaggtacaaccaactcgttggttgaaatatccgactacctgtacaagaagaatccggatggtgcaaacgaaatcatcaataagcttgcacagaaatattacggacatattgaagaactgtacagcactgccgaatataaacagaaagccaaagaacttgtaaaatctcatttcgattatatacgtacctttacaaaagacttgttcacgctgtttgaagaaaaggtggtactggcacagggagagttgatctcgactggtatgatgaacctgtatctgaacgaaacaggcgttaagtcagtcctgcttcccgcgttggaatatatgcgtacggataagaatgcagaaccggaccctgtttacatcaaagaacgcctggttaaattgctgaacgaacataaagatgctgaattatatatcacccagggttatatctgccgtaatgcatatggtgagatcgataacctgcaacgtggcggtagcgattatagtgcttctctgatcggttcggctctcaatgcagacgaaatccagatctggacagacatcgacggaatgcataacaacgacccgcgtatcgtagacaagacatcgcctgtccgtaacctgcatttcgaagaagcggctgagcttgcttacttcggtgccaagatcctgcacccgacctgtatccttccggccaagttgaacaatatcccggttcgtttattgaataccatgcagccggaagctcccggtacattgatctccaacgaaacggaaaaaggaaagatcaaagctgtcgctgcaaaagataatattatctccatcaagatcaagagcggccgcatgctgctggctaccggtttcctgcgtaaggtattcgaaatcttcgaaaactaccagacaccgatcgatatggtgactacttcagaagttggtgtatcggtcacgatcgacaaccgcaagcatctggaagaaattgtagacgacctgaagaaatacggtactgttactgtcgatcaggatatggtgatcgtatgtgtggtaggcgacctggaatgggataatgtcggtttcgaagcccgcatcgtccaggcaatgaaggatgtgccggtccgtatgatctcctacggtggaagcaactacaacgtttcgcttctggtgaaggccgcggataagaagaaagcgctgcaggcgttaagcgatcatttattcaacaactaaataatatgagggcagcctattcgagactgccctttttttaatttatatataataaaataatatgctcaaaggaacattcccgatagataaactgaaggcgcttcctacgcctttttattattatgatgtgaagttattgcaagatacgttggatctggtaaagactgaagccggcaagtataattatcatgtgcattatgccgtaaaagcaaatgccaatccgcgcattctttctattatagcagaaaacggactgggagccgactgcgtgagcggtggtgaagtacaggccgctttggatgccggatttcctgccgataaggtggtttttgccggtgtgggtaaagctgattgggagatcaacctggggttggataacgatattttctgttttaatgtggagtcggctgtcgaactggatatattgaacgaactggctgccgcgaagaataagatcgcttcggttgccctccgtatcaatcccgaagtagatgcacatacacatgccaagatcacgaccggtatgaaggagaataagttcggtatcaacctgagccagctcggtcaggtactggataacctttctacattaaagaatgtgaaactgatcggtattcattgccatatcggttcgcagatcacggatatgtcctccttccgtaatttggtgatccgtgtgaatgagatacaggaagagctggaagctcgcggtatccatattgaaaacctgaacttcggtggaggcctggggatcgactattatcatccgaatcatttgcctatccctgctttcgataactatttcgcagtattcaataagctgttgaaagttcgtcccggacagcaagtgcatttcgaaccgggtcgttcggtagtggcccagtgtggtacgcttatttcacaggttttgtatgtgaagatcggcgagacaaagaaatttgctattctcgacgccggttttacggaactgatccgtccggccatgtatgatgcttaccatcggatcgagaatatttccagtgatgaagcggtggaactttacgatgtggtaggtcctatctgtgaatcatccgatgtgttcggtaaagatgtggagctgaacaaagcccatcgcggcgacctgattgcattgcgttctgccggtgcttacggggaggtgatggcttcgaaatataactgccgccgtctgccgaaggcttactattcggataccatttaattgttaattaataatatagagaatgccgggtttctttgtttttgcaaaggttcccggttttcttgtttattgtgtttccttttttactacctttgtacgatccctttgtgtggagtcttgtaaggcattaatgattaacagatgaaatgtgaaatgagaaagaaagatttatattgggtatttgcggtttgtttgataatgttgtcttcctgtctgggtgattccactacccgcataacggtagggcttcaagaggctgtttaccaggttcgtccttccagggggcttgtcctgagagatgggcgcttgatatactcttccagcataaactcgttgcgtgccgatgccggagactgtttcctggtggagtattcttttgattctgccagccctgaattacaaaattctgacagcttatcggtcgaactgttggggacgcctgccgaagtccctttgtggacatccgaaggaactgttaaatctgacaccttgctgacagacgaacaatatatatctacgatagggagccgtacggcctacatcaaaggacgtcttttcctttggcctaccctgacggaaccggaaagccaggtggatagctttgtaatgcattatgatacggttaactggtacaccacagccgatggtttccgtacttataacctttatttacgtgcgatcagaaaatcggaaataccggcagatgcagactctgtgaaggtacctcatacggaagcattcgatattgaacgctttttcaataaagctttagagatggaaacagccaacaacgcggaaaagcttactattgcaattaattatgttgcaaaaccaaataaagatacaacagcagtcgaatggtctgtattggaattggattatcagttggaaaataagacgggagagtaatatatatacggataaaaataaaggtttgcggtagggggaggttaccgttattgatgataaaaggtctcgtataacaatttatatcccttatttttatacttttgtcattctaatagaaaacggagagatgtataaagagatattaaaatgggtaatagctatcatttcccagccgggaaaggcgtgggaaatgctgacaaagaaggaagataagggtgacgaattcttgtctaagtttgtgtatccgttgatcggactggttacagccgctgcttttctgggggtattatttacgcggaaggagtttgatatagaattggctctgaaatcctcgatcaagacattggtcgcttcgttcggtggtttttatctgggggcttacctgttgaatgagctttggcagggattctttaaaagaacgaaagatatgaaactttgccaacgctttgtcggttattcctcttcactgatgtttgcactgaacatcgtcctgatgctgttgccggagtttttctttctgcgtatttttatactttataccttttatatcgtatgggaaggagcagggccttatatgcaggtggcagagaatgaacgcctgaagtttgccggtatagcaaccgtagttattttactgacgccagccgtgatcgaatttgtactattcatgttgatgccgggcttgcgttattgacagatagaaaaagatgaaagaaaagattagtaataatatacagataaagaataagcgggccacattcgatttcgaattgctcgaaacattcaccgccgggatcgtattgaccgggacggagatcaaatcgatccgcctgggaaaagccagtctggtggatactttttgtattatggaaagaggcgagttatgggtaaagaacatgtatatcgccgaatatttctatggtacgtataataatcatgtggcacgccgcgaccgtaagctgttgctgacgaagaaggagctgcgcaagattgacggtgcagcccgcaacagcggtttcactattgttcctacccgcatgtttatcaatgagaagggactagccaaagtcgttgttgctatcgccaaaggtaagaaagaatacgataagcgcgattcgatcaaggcccgtgacgataagcgggagatggacagagcatttaaacggtaagatatattgacttgccgtttttcttatcaccaagaaaaaacatatctatgaataaagaaacttttatacggtccctgcaggagcgtatcctgattctggatggtggtatgggtaccatgatccagggcttcaaactgaatgaacaggattaccgcggcgatcgttttgccgatttccccggacagttgaaagggaacaacgacctgttgtgtattacccgtccggatgtcatcaaatccattcaccgtcaatacctggatgccggagcggatatctttgcaacgaacaccttcaatgccaatgcgatctctatggaagattatgctatgcaggagtttgtacgcgagatcaacctggcagccggaaagttgggacgtgaagtggctgacgagtttatggcggaacatccggaccggactatctttgttgccggttccatcggtccgaccaataaaaccgcttccatgagtcccgatgtcagtaaccctgcttatcgtgcggttacctataaagatgtctataaggcatataaggaacaggtggaagcactggtcgacggaggggtagatattatcctttttgaaacgactttcgatactttgaacgtgaaagccggattggaagcggcagaaactgttttaaaagaaaagggaaaagaactgccgatcatgttgtcgctgacgctttctgcccagggtggacggacgctttccggtcagacattaggagcctgcctggcttcggtccaacatatcaacctggttagtataggtctgaactgttctttcggagcagccgatatgaagcccttcctggcagatttggcaaaacatgccccctattatataagcgcgtatccgaatgcgggattacccaataccttcggtacttatgacgagacaccggaaaagatggccggacatgtaaagccgtttatcgaagaaggattagtaaatatattgggaggatgttgtggaacgacccccgcccatatcgcacagtatccagccttgataaaaggagcgaaaccgcatgtacctgttgcaaaaccggattgcttgtggttgtccggtcttgaattgctcgaagtaaagaaagaaaataactttatcaatataggtgaacgttgtaacgtagccggttcgcgtaaattcctgcgcctgatcaaagaaggaagttatgaagaggcgctgaccatcgcccgtaagcaggtggaagacggggctcaggtgatcgatatcaatatggatgacggaatgctcgatgcagtgaaggaaatgacaactttcctgaatctcgtggcatccgaaccggatattgcccgtgtaccagtcatgatcgactcttccaaatgggaagtgatcgaagaaggcctgatgtgcgtacagggtaaaagtatcgtcaactcgatctcgttgaaagaaggagaagaggtattcctggcccatgccgcccgtatcaaacagttgggagcagctgttgtcgtgatggctttcgatgagaaaggacaggcggataccttcgaacggaaagcggaagtctgcggacgtgcttaccgtttgcttcgggagaaaatagacttcgatccgtatggaattatattcgacccgaatgtattggctatcgctaccggtatggaagaacataacggatacggtttggactttatccgtgcggtcgagtggatcaaacagaatctgccgggtgcgaaggttagtggcggtatcagcaacctttcgttctcgttccgtggaaataattatgtacgtgaagcgatgcattccgtattcctctaccatgcgatcagtaaagggttggatatgggtattgtcaatccctcttcggccgtactttatgaagatatagaaccggaattccgtgatttactggaagatgtgatcctgtaccgtcgtccggaagctgccgaagaattgatcacctatgcccagaacctgcatgtggaaaagcagggcggtgcggaagaaaagcatgaagcctggcgcgaacaaccgctgaaagagcgtttggaacacgccttgatcaaaggtataggcgatcatctggaagaagacctggcggaagcacttactctttatccgcgtgcagtggatattatcgacggtccgctgatgagcgggatgaataaggtcggcgaattgttcggtgccggtaaaatgttcctgccgcaagtggtgaagacagctcgtacgatgaaaaaggctgttgctatcctgcaacctgctattgaagcggaaaaatcggcatccggttcggctaaagccggaaaggtagtctttgctactgtaaaaggggatgtacacgatatcggaaagaatattgtatcgatcgttctggcatgtaataattatgaagtgatcgacctgggagtaatggttccggccgaagtgatcatacagacagccataaaagaaaagcccgacctggtttgcctgtccggcctgattactccttcactagaagaaatggtgcatgttactgacgaaatgcagaaggccggacttacgatacctgttatggtaggcggagcgacgacctcgaagctgcatacggccattaaaatagcacctcattacgattatcctgtcattcacgtgctcgatgcttcgcagaatccattgattgcggcaaaattgctgaatcccgatacccgtgaagcatatatcgaaggactgaataaagaatatgaggccctccgtgcctccatggagaagaaaaaagaaatattggttccgttgtcggaagcccgtctaaacccgcagaagatcgactggtctgcgtggacaccggttgttccgaatcacccgggtgttcatgtgataccttatattccgttggaggagatcattccttatatacactggaccttcttctttagtgcctggaaactgaacggacgttttgctgccatcacacagatccatggttgtgatgcttgtcgtgcagcctggttggcagactttccggaagctgaacgtccgaaagcggcagaggccatgcagttgtataaagatgctgttaaactgctggatcagttggtagatatgaaggctgaatattgtaaagctatttacggtttcttccccgctaacagtgacggtgataacattaaaatgggagatattgtacttccggtattacgtcaacagtcgaagaaggaggaaggtatctacaaatcgctggccgactatgtcatgccggcttccgaaggtcgtacggattatgccggtgcatttgtcgtgacggccggtgccggagccgaagaactgaagaataaactggaaaaagaaggcgacacgtatagctccatgttgctccagacgctgacagaccgtttggctgaagcagttgcagagtatcttcatgaaaaggtacgaaaggaatattggggatatgccccggatgaatcgttgtcgatttccgatctgtataaagtgaaatatcagggtatccgtccagcggtaggttatccctcgttgcccgaccagttgcttaattatacattggataatctgttggatatgtcccgaatcggtgttaagctgacggagaatggagcgatgtatcctacggcaacagtcagcggtatttatttcgcccatcctgattcgcaatatttcatgatcggttcgatcgatgaagaacagatgaaggattattctgctcgtcgtaacctgtcggaagcggatgtcaggaagttgttgaataaaaatatcatctaagtgactgtgatggtgaaagattggatcaaaaagatacgtattcgctggattgttctggccgtatccctgattttgatatgggttataatggctttgcctgcatggggagaaggttatgcccgtacgatttatccattcttttcggctgtcttgtcgcgtatatcttctgtatttcctttttccataggcgattgttttatttacggaagtattgccgggttggttatctattgggtatatgctattgtgaaacgtcgctcatggaaaacggtaatcgggcgtactgtcgaatatctgttatgggtttatatctggttttacatggcttgggggttaaactatttccgggagaacttttttgaccggacagagatcccttaccttgcttattccgaagatgacttccgttctttcctgtcggcttataccgactcgttgaatgtctcttttactcctgtggaaaagatcaaccgggctgttgtggcagaggaagtagaaagcggctatcgcgaaatagccggacaattcggcctggtttctcctgcctcttatcttcatccgaagccgatgctgattccatccctgatgagcggtgtcggggtattgggatatataggccctttcttcatcgaatataatctgaatccggacctccttccggtgcagtatccttttacctatgcgcatgaaatggcgcatgtcttggggatttcgagtgaagcggaagccaacttgtacggatttctggtgtgttcccgttccggcaaccctgaaatacgcttctccgcttattttgccctcttgccttatgtgctgggcaacgcttatcagctattgccggaagaagaattcgagcaatggaaggagacgatatccccggaagtaaaaaaggcttacaacgataaggtagcttattggcaggcactgtataatccgacgatcggtgagatccaggataccgtttacaactggttcctgaaaggaaataatatcccctcaggacggaagaattattcggaagtcgtggccctcctgatggcagttaatgcatcacagccggaaaaataattggccggtcaaacctcgaatgaaatattttcctacatttgtaacggcttcttttacaatagattttatataatactttaaaactaatagaatgaaaaatcaagtactagcatatatgctggccggtattgccgttttaggactggctagttgtactccgcaatcgacgacaattgaaggaaaagtctcgaatatttccggtaataccatcatctattggccgacggcggatggtgtatataactctacccggcgggatacactgtttgtacaggcggatagtacgtatcatataacgcttcctggtagcgggaatgaaaaaatatctttttatgtctatggacagagatatctggggacgatatatgtaggacccggaacgaataagctcgatatcgatgcctcccttgaacactccctgaacatagagaataaactggtgaaagagaatgaaattgtgaaggagctttcccaggtgcaggaggatgttttcaatttaagagctcgtaaaggcgacgttttcgacgtggaaaaagatacggtggcctcttctgtttatcaaaagttgaccgattatggggcgtcgattgaacagaaaatagtcggtgtagacgagctcttcaagaaaagagccgttcaggatatacgtatgcagatgctattggcttttatgaaccagtatttcgggatcaattaccggggatcggaagaagcgaagaaggaatgggagactgtttatccgaaaatgctggcgtatacagatataaaccagccggagaatgtcttttccgaagcgttcgccgatgtcatagggagtgctgccggaatcgaactatatatgaagaccggacaacaaccgaccagccggaatgaaagtaatcagaaattgttcgattggtataaggttaacctgaaaggacgtgtacaggaagttgcgatgagtaatattatcttggaagatgcctcgaacgaaaccttttctaccgatatcccttccttgtatggacagtttaaagaattgtatccgtccagtaagctgatccctgccctggatgaggctgtacagaaaaatatatcgttcaacaagcttgatctcccggaaggtatccatattttgaatacggacagtgtacgttcctttaaagaaataaccgaccggtatttgggtaaagttatttttatagatatctgggctacctggtgtggtccttgccgtgcttcgtttgcccatgtgaaacctttacagcagtatgcaaaagaaaatgatatcgtattgttgtatgtttctatcgaccgtccgatgaatgcggatctatggaaaaagatggccggctattacgaccttaaaggcgatcatgttattattaatgagtattttaagatggatgtctataatacctatggcaataacggaatgttaagtatccctcattgtgccattatcaacaaaaaaggagaactgcaatttaaaggagccgcaagccctgaaaatatggataagctggctgaacagttgcaggaagcggcccaataagttttaaaaagcatatagaatttcaataagcctttacgagagcaggtttttgggaaacaacaataagattaacggcaggtaatcttttaaagtaacccgtagctgtttcaaggcttgttggattctgtaattcactgtttggggcgatacttgtaagatatcggcaatctccttgtaacttttattttcgaagcgatgcatgacaaaagcctcccggtagctggcgggtaaggcttgtatggcctggctgatatgtttcttcaaatcttccgtctgtgagaaatcgctgtcttgcagcatttccagcatatactcataatagcgcgtttccgcccgcagttgcgactgttggcgagtgagctggttgatgcttctgtggtagaccgctttgtacagatattggctgaaagaggtattaaacgtttgtatctccctgttttcccataaccataacataacatcctgcacgatctcttcggcatcttccagactgacgaaccggctggcatacgaacataacataggatagtatcttctgaacaaggtaccgtaagccttcttatctccgcgttgcatggctgatagtaaaagtgtatcctcagtaggttgtaacgtattttgcattctatggttctccttggtggcaaagttagtttttttgttgaataaaaaaaattatagaaaaaagtgactcctcgtttagtaatctgtcggagttcccttgtctaatatataaatgagcataaaaaagcggatggaaacatttaatatagataagatagaagaaattcttccccggtattgcagcggtgaagcaacggtggaggaatgccttttggtggaggtgtggatgcagcaatcggaagaaaattatcggattgtcaaacaaatatacgcgatagaccaagtgatgggtacgacccggatggaatcggtggtgaatacggaaaaggctttagcctccgtgagtcgtaagatgagtaaggaacgcgtacgagtgagctggttcacctgggtacaacgggtggcagctattcttttcgttcctcttcttatcacttgggggatcgagcattttaccccccgtactgaaatagcccgtatgatcgaggtgaaaacaaatccgggaatgaccacgacagtcgatcttcccgacggatcgaaagtctaccttaattcggaatcctctttgacctatccttcattttttagtcagggcaagagagatgtacagttgaaaggggaagcatttttcgaaattcagaaagatcctgaacaccgtttcattgtttcaacccccgcccatacgcagattgaggtattgggaacatcctttaatgtagaagctttcgagaaggattcatttatatccaccaccctggtagaaggaaaagttcgctttgcttatctgaaagatcagcagcccacagcggtagtaatgaaacccgggcagaaactgatgtataacacgacttcttcgcaggtaagactgctccaaacaagctgtgaaacagaaaccgcctggaaagacggaaagatcgtgttccaggcaacccctctgcccgaagccttgcggatgttggaaaagcggtttaatgtaaccttcgttttatccaacgagcgtcttcgcacggaagcgttcaacggctcgtttaccaatcaacggttagaacgaatattggaaatatttaaaatatcatcgaatataaaatggcgttatctggatacccggaatacgactaatgagagaacgagaatagaaatttattaacctaattgaaaaaatcatgaaaagcagatcaccttaaagaaaaacatccggagaaatattggagtatttcaccggatggaaagaattcatttaaaacgcttgtttggagacaagcatagtaaaccattttttattaattagatcagtacaaagttatgcaaaaacattttaatacccaacagttttgggtagcagagtttctgcggtttatcttaaataaaataccaagagttatgaagttatcagtcttcttactaatatgttctattggtttggcgcaagcaacaggtagctatgctcagaaagctactgtaagtctggagatgcggaaccaaacggtaaaggaggtattggatgagatcgaggaacagtctgatttctctttcttcttcaatatcaaacatgtcgacctggatcggagggtctctgtcgtggctaagaaaagcgatatatttaaagtattggaaactgtgtttgccggtacgaatgttcgttattcggtggtggatagaaagattattctgtcgacagagaagccggatgttcaacaggctaaagaagagagaaaaattaagggtgttgtcaaagatcaaaatggagagccggttatcggagcaaatgtgtctgtgaaaggtacaactttaggaacaatcaccggtctcgatggtgattttgtgctggaagttccggaaaatgctctaatccaggtttcttatatcggttatgtctctcaggagcttcgtttgggaggccggaaccacttggatgttgtgttgaaggaagactctcaagcgttggaagaagtcgttgtcgtgggatatggcgtacagaaaaaagtaaatctgacaggttcggtatcttctattaaaagtgaggaattagaacgtcaaccgatcgttacgatgaaagatgctttgtctggtttggctccgggtttgactgtcgtgaagtcgtcgggacaaccggggtcaagtaatcctactatcacggtacgtggagtgggtacatggaaaaattcaggtcctctggtattggtagacggtatgtcgatgagtattgcggatgttttacctaatgatattgagagcatatcggtattaaaagatgcagcttcggctgccatttacggttcacgtgctgccaatggagtcatattgattactactaaaaaaggtaaggtcggtaagatacaagtaaattataatggcaatgtcggttggcaacaggctacgcgccaacctaaatcagctacaggctggcaatatgcagagttgtataatcgtgctatgttagccgatggaaaggcattacctgacggaactactttaacattcccacaggatatgattgatcgtatgaaagacggtacggggaatattgaccataatgaagctaacactgactggtatgatgaattgttgcaaacagctttacaacatactcatgatctgtctgtttcgggaggaaacgaccgtttacaatatgttggtacagttggttatgcaaaacaggatggtattatcaaatcttcttatgaacggtataatacgcgcttgaatacgacggctaatttagctgattggctgactcttcagtctaatattgcttatattaatgatgtcagcaaagaaagccctggtcttggttatgcttattattatgcacctcgtgcttatccgaatatgccggttcaatattcagacggaacctggtcgtttcattctacacctaaaaatccggtacgaatgacgactgacgattatggttatcaacgatatgaaacggataaattatcattgttattttctccggaaatcaaattgttcgataattcattcttcttgaaaggcgtattgggatatgaaagtaaaacatcttatgttgataagtttgaaaagaaagttatttatgatgcttttgagccggccggacaaggagagaatatttttgtggcacgtaataccaaaactgatacctggtatcggaacaggaatctgacattgagtgcaacggctaattatgtaaaaagttttggagatcatgatattaatttgttattgggagcatcacgcgaacagttcaggtataatacaactgtggcttcacgaaaagatttcccaaccgatgatttcgaagtgatcgatccgggtgatgcttctacggctacagcgagcgggaataaaacgtatgatgcgttagtctctgtattcggtagggtaaactattcttacaaagaccgctatctgtttgaagccaatatccgtcgtgacggttcttctaagtttgcacgcggccaccgttggggtacgttcccttctttttctgcagcctggagaatctcggaggaatcatttttcaatccgcttaaaaatgctgtgcagaaccttaagttacgtgcatcgtggggtaagttgggtaaccagagtattgacaggtatctgagtatgtctacttacaatgtggttccgggaagtacccgtttttatatgtttgacggaacggttcaaacattgatgtctgaaagtgtcatggggaataatattatcacatgggagaccagtacaaaccttaatttcggtctcgatgtcaatgtgcttgataaccggttaggctttactttcgattggtataaccgggatacggatgatattttgttgagtctcgaagcgcccagcctgttgggaattacgccgccaatttcgaatgcaggaaaagtaagaaataggggatgggagttaactatcaactggcaggatcaaataaacgaagacttcagttataatgtcaatttcatgttgtctgatgtcaggaataaaattctggatatgaatggttacaagtcgccgacatccagcctgaccacccgtattgaaggtgaaccgatcgatgctctgttcggttggaaaacactgggacttgccgatacacaggaaaagtatgagcaatataaagaggttatgtcgacatataattctgatttctcgatgggagatatcattattgaggatttggataaagacggaaaaataacggaagccgacaagacgattatcggtaaccagatacctcgttatactttcagtttaaacctgggattcaattataaggcttttgacttctctgccatgtttcaaggagtaggcaaagtcgatggtttcctgggacgcgacatcatcgagccattaggttctcagacggctatggaagaacattattatgattctttcgatccgtctaatcccactaccggtaaatattatccacgtatgacaatggctaaccgcctcaattatgctaatatgtcgcattgggtacaagatgcttcttatctgcgtttgaaaaacttgcaggtaggttatacatttaagttcggcgagaagattccggtggagagagttagagtatatttctcgggatctaatttgtttacgttgacgaaatatagagtctttgatccagagaacggattgaatactacttctttcccgaatgtgagagtatatagtgtcggtgctagtgttacattttaaaaacagcaattatcatgaaaaataaatttttatcaatagccattttattaggatgcacgttatgttcttgcgacgatatgttggatgcattaccagaagataaattaccgcaggaaactttttggcaaacgcctggtaatctccgtgcatttgtggcagacgtatattcccgttcttttccactggaatacgaaatgcacccctgttttgatgaagcgatgtccgataatacttatatggtatgggaaggatggtatactgatctcaaactgataggtaacggatcatatcttacaacgacctctgttataaataataattgggcatatgcctatacaaatattcgtatggcttggcagttcctggaaaatgtagagaagtgtacagagttggatgccactgaaagagaggctctcaccggacaaatccgctttttcctggcttatagctatatccgtttagtagccctatacggggatgtaccattagtagagaaagtcttgaatgaagaagaggctaagaatcaggtcagaacacctaaggccgaagtgttggcctttgctcacaatcagctcgatcaggccataaaggaactggatggtaaaacgtttgaaaaaggacgtgttacggcaggtgcatgtaaggctttgaaagcacgtgcttatttatgggataatgatttcagtaacttgttgacggttacatcggaattgataggtaaatattcactcaacactgctggcgagacaccttatgccgacctgttcaatggaaatgccgaagattcgaatgagataatcctggcacgtgaacatgctcatacaactggaagtatctcgacaggtaatagcttgaatcaagcattctttttaaaagaaatgtcaggaggagatgcatttcgtgcgcttacacccactggaagtctggtcgatgcttatcctatggccgatgggcggttgatacatgaaaatggttccacttataatccaaaagacccttataaagacagagatcctcgtttggcacaatctattatctatccgacttctactatccgtgaatcaaaaacgatgacatgggtgctctatgatccggaatctgaagaaagtattccgggacaacgttacgacgcaaaagagccttcgccaaccggatatgtgtggaagaaatattgcgattggagtgatcatgccatggtacaaatattggatggtggtgtagatgttatttacttccgctatgctgatgttctgttgatgcatgccgaagcattactcgaaacgaaaggtgttgctgcttcatctgagatttttgcccttatcaatcaattacgcgatcgttgtggcggaggacgtgtgttggaagccaattatacatcggaagatgcgctgcggacattggtgcgtaacgaacgtcgcgttgaattggccaatgaaggtttacgtttcttcgatatacggcgctggaaggtggctgaaaaaacaacggctgtctctggtgaaggaatgaatggtgaactttacggtgcattcatgcgtctggacggtgtaggtgctactgatagaacagtaaccgtcgatggtgcgccgcgtcgttatgtggaaaagcgtaactttgatcctgctaagcattacctcttcccggtaccgtctaaagatattgatctatctaatggaacgttaactcaaaatccgggatggaactaattataaacttataagtttcaatttttatatgaactattattctttggccgtaaccctgctcatgtcagggctactggccggatgtcaagcccgtgaaaagaaggtattggacgggaatggtgaaaatgccgttcctgtatcgacccataggatgcttaatccgatagcacctccgggagtatatattgctgatccggaagtgaggcagatgcctgacgggcgtatttatgtctatgggtcgcgtgatgaacctggtaatgactggtgctcgcactcttatcatgtactttcttcttctgaccttgtgaattggcatgtggaacaattttcttttgccactgaaggtttagggaagcaagtcgattatacagacaggcttttatatgctccggattgtatttataaggatggaaaatactatctctactattgcctggccggaggtggagatgatgaaggcgttgcagtctcttcttctccttacggtccgttcagagatgggaaaaaaatagaagggataagtggtatcgacccgtctgtattcatcgacgatgacgggcagggctatctgttctggggacaatggcatgccaggggagcaaaattgagtaaagatatgctctctatagaaggggctgtccatgacagtctgctgacatacaatacgcattttttcaatgaaggcagttctgtccggaaaaggaacggcatctattatttggtatatggaagccattcccggcatggcaaatccaactgtgcgactttggattatgcgacagcgacatctccgttaggtccttatacgtatagaggggttattgtcgataattggggaagcgacaggaatctggtgaataaccatggttgtataaccgaaataaacggacaatggtatattgcttatcaccgccctacccatgcgactgcaactggaaccatgcggaaagcctgcctggagcctatcatttttaatccggacggcacgattccggaagtggaaatgaccacgcagggaatcggcggtcctatctctcctttttatcggatggatgcggcgagagcttgtctgatgtcgggaaatgtgatggtttcggtacgtagaccggagaatgatatccctgtggagtatttgtctgccattcgtgacggcgatcatgcttattggaaatattatgattttaccgatacggatgtcagccattttgtttgtaagacatggaatgaaaacagggctgcaaaaatagagattcgtctggatagtccgcaaggcgagttactcggagtatgcgatattgccccgatgaatggccaggtggcttatgctatacatgaaacaaaaattaaaccggttacaggaaaacatgccttggtactggtctttaaatcggttgaaccggaaatgaaggaggttaatttaatgaatctggaatggtttgtttttgagaaaagagaatagggtgaaattacagtttcaggcaaacaggactattgtgttatcgaagatagcattatagtcctgcttgtttgtatattattgtatatggtaaaagttataacaaaagttttataataataatccttcattccttcatctgtgtgtattatcgtctttgtaatcatttgtttacagctgaaggaaatgaataaacccttgtgctcttatacccgcctttctccaattttccttcatctatcagtttttttagatcttccaatgcacggtatttggagcaacccgtcagctcccggtagtcgctgcaagtgatataatgatgtgtgttcaagtattctgtcagcctgcgcacacgttcttcgaaagaaggcagaacgccttttccttccggtatacgttccaggtgcattgactttagcttgcttttcaggtattttccgcaccggaaattcacattgcggaaatggatcgactcgctgcggatttcttttttatccattaccggacgcgaagctagtgaaacgctgaaaaagccgataccgtccaattctacattatatccttcatccaatcggaaagccatcatatcggcaatgacttgcaaagcccttttgatatcggctcccgaaattccggaacggccttccgcttcctttatcagatcattggtatggattgtcccgtaaggtactacacgcggatgtaacgcctgttttttcttgtctcccgtggggttcggattgcgaaccattcgatatcttgcacacatatcagtatttgtttaaggtaaaactatgtattccgtaattccgaagtgccttactctgttttgtttgtcaattgtcgtatgcttgtccggcagctgccaaacttcctcggatcgttttcggtgcagaattgaaaaagaaaaatgagactttggagatgaaggcttacaacggtcttgttctattggaagtcgataacctgtcgggcgatacgacggcgaaatgggtaatatcccttcgtcaggtattccttgaacagagccaacgggcgttctgtacccggcagttctactttatgttccaatatctcttgcagggaataggccgatagccggatatcttttgctaatataagatattcgcggaaagagagtcctgggaggaagtaactgagtgcccagcggctcaaatccgcattacctttatagatgtccaggatggaggaaccggtaaagataacttggaaatcgggataatagtcataaatcattttcagctccttcgaccagtcctgatatttatgtacttcatcgatgaataggtgtttcccgccgtttttgtagaagtctgacgcaaggtcaaacaggcggtgttctgcgaaataaatatcatcggcattgataaaaagcgtatcctccacatggtggtacagtttgatatgctgcaatagcatggtggttttgcctacgcctctggggtctactattcccagcatccgggaagactagtctatccggtcgtgcaggtatctgacataagatgtgtcggtgagcctgagcaatcttctaaaaagttctataagctgttccattgtctgattgaattggtttcttacaggcaaagatattaaaattgccggatgaaaccagcagttttgctataaaactgcacttttaaagtagcataattgcattaccttcaaccaaagatacctgacaaataccgacaaataccgacaaataccgacagacagtgacaaccgccgacaatggcggacagggcctttccggcctgccgtacttttacagtgtaatacacagagtagctttttcgattaagcccggcttatcgtcacggcttatccggcagctgccgcggttagttagtatccttctgcttttgcacgtgaaattgcatacagcaaatatatcagtgaggtgaacggcgataaccgggccgtttactgccggttgctcgatagtttttcgacgacgatcggtaaattgctcacgataccggtgtcaacccgggcttaccccgagttgacaggagaacgactttattgtaacttgaatctacgggatcctaaaatatttgcttatatttgcgcgaatcagtatattttgtctgatggagaatggagatataaattctaataaaagaatcgtagaagaactattcaggaaatactataaagtcttgagagcgtatgcctatcgtttattgggagataaagatatggcagaggatattgtgcaagatgcttattatgaattgtggaaaaagcaggaacaattgattatgcaggatgccataaagtcatatcttttccgttcggtatatacaaaatcactcaattgtttgaacagtaaggaatatacagagcaggaatcgtttgaacaatctaccgaaggtaaaatacagaaaatgtatatacaatcccagttgctggatcaggaaagcgatttgatgtataaagagttgcagacagcaatcaatacaataatcgacggtctgcccgatcaatgtaaaaaagttttcatacttagccggaaatatgaactgaagaaccgcgaaatagccgaacgcctggatatatcattgaaaacagtagaaaaacatataaccaaagccttgttcatattgcgctcgaatctgaaagatagtacaggaattcttttacttcctttttttctatagaatccgaatcaattttatttcattacagaggtagggtcttttctgtttcatttgttctactttaaagacaacagaaaaagagagtatggatatagatgaaactattggtaagtatctgaacaattcggctacaaaggaggagaaggaaatccttttagtatggttggaggataaagaggaaaaccgcaataaatttaaagaaatgtatgatctgtggttatacagcaacgctttattgacagacaataaagatatggaagctgcattagcccgtctgaatgaacgtacttctctagcctctaaacgaactgtgtctgttcgtcttttcagttttcatgttatgcgggtggctgctgctatccttttgttgttctctgcaggttatgtgggttattacctgaaaggaaatgaagaggagactgtaataacgatgaataaattgttaaccggagataataataagggacaatatgttttaccggacggatctaccgtgtggctgaatgcgaatagtgtattggaataccctgatacctttacaggtaaaaagcggatggtacgattaaaaggagaagccttgtttgaagtaaaaaaggatacaagtaatccttttgttgtgcaaacgggaggaatggacattgaagtgttgggtacttgttttctggttcaaaactatcctgataagccaacggtggaaacggtattggttaatggtagtgtaaaaatagaaggcaattatttccctgaatcccgtatattggttcccggccagatgattgcatacaataaaaatacggcaaaaactgatctgagtatggtagacactgctgattataccaactggattcattcaaaattggtatttgataaaacgaaccttgctcacgttattattaatttggagaagtggtatggcatcagaatcgtagcttctcctgaattagttcaaaatacacatatgtcgtttactgtccgtagggagtcgctggatgagatactcaaatatatgtcgttgacagctccgatagcctataaatggaaagacaatgtattgtatttgtcttcgaaagaataaaaagagtgagttgaaaacaaagtattaacctttaattgtaatgcaatatgtagaaagacacagaaagtaaaaaagataggcgaatgcgctaacactcacctatcacaagatcttaaattaacaaacatttctctccccagagtaatgattattttaaaatttaaaatccatacaaagttatgaataaatcaaatgggaaaagtgtgttatgccttttcttaacagaaaaaaatatccgtattatgaaacatacgtgttttatgttaatcttattcgtattccagagtgcggccactacttatgctcagcacacccggattagtctggatctgaaacagtcctcgttaaaagaggtgtttaaagaaatagagtcgaagactgaattcacattcttttataatgatgaaataataaacctggagcgtatcatagatgtacaagtaaagaatgaaaccattgaaagtcttttaaacaggatattgacaaatagtacctttgttattgagaataagaatattttgctgataccaaaggagtcgaaagaaccttcccatccgggtattcagcagacgaaacgagaaattataggaaaagtaacagatgaacgtggagaacccattctcggagttaatgtactggagaaaggaacaacgaatggagtcattaccgatgtcgacgggaaatttatcttatctgtttcacctaacgcaacattgacattttcttatatcggatatgtgtcaattgaaatatcggttagcaataagaactcgataaccattatcatgaaagaaaatagcgaattgttgaatgaggtgattgttgttggttttgggtctcagaaaaaggaaaatctgacaggtgcagtttctcagataaagatggaagatgtattggggaatcgtccggtcgttagtgcgatgggagcattacaaggggccatgccgggactctatatatcaggagggtctactccgggcgaaagtaaaagttttaatatccgtggaacgacatctatcaacggtggtagtccgttagtattgattgataatgttcctggtgatatcgacatgctgaatccagaagatatacaatccgtttccgtattgaaggatgtggcttcatctgccatttatggagcacgggcggcatttggagttatattggtgacaacgaagaaggctaaaaagaaagatcgtttccaattaaattataataataatttcggcttccaaaagtctgtgaatctgttggaacctgtttctgctatggagtttttacgggtgtataaagatactgattggctgtcggggcattttgtttatggacaaaatctggataaatggatgcaatatttgtcagagtatcaaaacgacccgggcaaattcaatgtaataggagatggtatttatattccgacggaagataatgcggcaggaacacgatattatttgaatgaaaaggatttgacgagaaatatattggataattttggatttctacaaaatcataatgtatcggcatcgggtggtacagataaagcaagttatcgtctgtctttgggatataatgatgaaaaaggtgttttaattacggatttggaccgttataaacgtataacagcagcatcttatgtctctttggatgtgaccagttggttaacgcaagagatggatgtgcggtatgcccgctctaaaaaatccgtgccacacggaaaaggtatttatggaactggcgatatgcctttgacaccggaaggggagatggccgcagcagatggtactatgcttccagtcgggactcccagaaatagtttgttgaatgctactcctgatataaagaacatagagaatccacgtattttttcgaaaacaacctttaagccggttaaaggcttggatgtcgttttcgaatatacgtatgataaaacgatatatgaccaaaaggtttatgacaaaccttacaatcaaacatcaatgcaattaggcaatgtcccgctttatgcaacatcgagatatgaaaatactaaatatacgattaactataatgccataaatctgtttggaacttatcagctcaacatcggcgaagatcataattttaaattgatggtcggatataatcaagagtcgagccgtaaagagcaactgaaggttgaacgtttaggcatgataaatgaggaatatccatcttttagtagtgctacaggcgagaggacaatcatagacgattacagcgaatatgctgttcggggagcattttatcgctttaattatgattacaaaggacggtatttgtttgaggcgaatggccgttatgacggttcgtcaagattcccgaaagataatcgtttcggctttttcccctctttctctttgggatggaatctggcaaaagaaaatttcattgctgattatgatacatggttgagtgaactgaaattcagagtctcctggggacagatcggcaatcagtccatcagcaactatgcttttgtcccgacaatgggggcttatttaggctcttggatttatgaagggaaacagcctactacattggaggttccagcattggtcagcagtcactttacttgggaaacggtcgaaacgacggatgtgggtttggacttgtcggtgttcaataatcgtttgaatttgactgcggactggtatatccgggatacgaaagatatgttagctccgggaatggaattaccatctgtgttaggtgcagatgctccgcagcaaaatgttgcggatctgcggacaaaaggttgggagataactgttggatggagagataaaatcggcgattggggatataatgtcggatttaatatttatgattccaaaacaaaaataacaaagttcgataatgcaaattatttgttggggagtccgatgaatacggatgacagcaagcatacgaattatatcggtcgggagatcggggaactttggggatatgtaacggacggattctatacgatagatgattttgaagatatacatacctggaaattaaaggaaggagttgtttccgttcagggagtcaatgtgcaacccggagatataaagtataagaatctgcatgatgacaaaaacagtgtcaatcagatcgatttaggtgacaatacattggagaatccgggtgatatacaggttatcggtaatacccagcctcgttttcattacggcataaatttaggagttagctggaagactttgacactggatgttctgttgcagggagtcggaaagcgggattattattcagcttcggcagtatttccgttcggaggaagcgaatttggaggtttgtatgagggacaattggattactggaaaccggtcgatgcggcgaatggaaattatacggctctgaatccggaagcttggctgccacgtatttatgatgaatatgaaaactacagttacaacagtagagtccaaacgaaatatatgttggatgcttcttatttgcgtataaaaaatgtaacattgggttataccttacctaagacactgacagaaaagatccggttgaatggtgtaaagttttatgtcagtgtagaaaatctgcatactttctcctctttgccgatggggtttgatccggagcgtttaagctggggatatcctttttatcgtacaatatcgttagggtttaatttaaatctttaaatgaatagattatgaagaatataattataaaattgataatcgccatgttggtactcagttcatgtaacgatagctttctggataggctaccggttgaagatttgactgaggagacctcgtttgaaacctatgataatttcaaaacgtatgcatggtctttgtatgatgtttttgaaaatgataatattctaaaacgattgggagatagtgcttcagagggattgtatgagagcgatcagtatgccgggtatttgagtaacaaaggcgtaagctcttataatccttatgcttttcaaacgattgtcaactcgacaaccggaaacggatgggattttagttatatccgcaaagtaaatgtaatgcttgaaaatattgaaagttcatcgttgagtgaggcagacaaagaacattggcgttcggtggggtattttttccgttcatattattacatggaactaatcgcgcgctttggagatgtgccttggttggaacatgttcttacggatgacgacgaagcgctttatgcagccagaacaccccgaaaagaggtggcagataaggtgttggaaaatcttcaatatgcagagactcatatcaaagagggtggagacggagcgaatacgataaatagacattgtatacgtgctctgatttcaagatttaccttgtttgaaggaacgtggcgcaagtatcatgggctgggagatgaaactgaatatttgcaggaatgtgttcgtgtttcggaagaattaatgaaagtctacccgactttacattctgactggggagaggaatggacttctcctgatttatccgtgattccgggtattattttttataaagaatatattgctgaaataatcaccaaccgctattcgcatttggaacgaaatcagtatcatggagttgagatgcctcagctgactgtcgatatgtatctttgccaggatggaaagccgatttcgggcagtgctgtttacgagtgggggaaaaaggataaatcgatctattcggtattccggcatcgtgatcatcgtttattggaaacggtggctcctccttatgaattggctgcaacatcgagtgaagcgagttgggattatcatagtaatccggcatatagggaatatatcgatatgctgggaccgaattttgtcattgcgaatccgggtgaacaagggaaacataagattttgcctttgcttcagtggagtggccggatcgttttaaaagttccgaatataacgactaaatccaaacagcaaatcctgacctgtcgtggcggatattatgtgtatagaaattattgtgtttgggatgagaatagtaataagtttgctgccaatgtagcggataagcccattttcaaaatagatgaagtgttattgaactatgcggaagccatgtatgaactgggccggtttacgcaagatgtggctgaccggactatcaataaacttcgcccgagagcgaatgttgccgacatgaaaatagcggaaattaacgatagcttcgatccgaaacgagacaagactgtcgaaccgctattgtgggagattcgtcgtgaaagaattatcgaattaatgggcgaaggatttggtttctatgatgtgcgccgttggaagaaagctgattattttgttaatcggcctcaatacggcatgtgggcgacaagagaagagatcggaacgggcaagatttataattcggaaacaggattgcctgaccagagtgcgccggaagggtatatttatttgtttaatgatccgttgaaagaaggaaagggatggttggataaatactatttatatatgataccgtctaatgatatcatattaaatccgaatttggttcaaaatccgggatggaattaatatatcgaactcatttattattgtagataatcagaagagaagaggtcacatctaatcattataacgatgagacctctctcacacaaatgtttagtatgaaaatccagaataaaatattactatcagccggattaatttttccgggaatattgatggcacagcaatctcccaacatcgtactgattaacattgatgacttggggtggacggatataagttcaaatggcagtacatactatgagactcctcatatcgacgatttaagaaaaaaaggtatctggatgaatgaggcctattccggatcttccaatagtgccccaagtcgggcatgtatgttgacgggaatgtacactccccgtcatggcatttatacggtggggactcccgatagaggagaagcctgtaaaagaaaactcattacaattcccaatcgccgggtattggagccgggtatccaaattcttccacaagtattaaaagaagccggatatcaaacctgccatattgggaaatggcatgtgacggatgatcctactgaaaatgggatagacctgaatattggaggaaatcatgccggaggtacaaaaagtcatttttctccttattcgaataaagacctgaaagatggtcctgaaggtgaatatctgatggatcggctgggagatgaagcggtcgactatttacgtacggtagacagagatcggccgttcttcttgtatctggcaacatttgccgtgcatacgcctttgcaggcagattcaagtttggttgcaaagtataaaaagaagcaaacagctccgggacatgataatccgatttatgccgcgatggttgaaaatatggattacaatgtagggaaagtattggctgagataagaaagcagggcctggaagataatacattaatagtatttacttctgataatggcggattataccgtgtctcttgtcagtggccgttaagagcgggaaagggttctttttatgaagggggtatccggattcctatgattatttatcaaaaaggacgctttgaagcaaaagagattgctcatgttcctgtgtcgcaaatagatttgtttcctacttttttggatattataggtataaagcgaacagatctcacactggatggagaaagtctactgcctctattgtcgggaaagaatacggataagtatcaggaacggccgctttactggcattttcccgcttatttggaggggaatgctaaagatacggaacagacagggccgtattttcgtacccgtccggtatctgtcgttcggcagggcgattggaagttaattgaaaattatgaaactggaaatctggaactgtataatatcagtgcggatatatccgaaaagaaagatcttgcacaacaaaatagagagaaaaaggaggagctgtatcagctattgtcgaattggaagcggcaggtacaagcgccggtcccaacagtgttaaatccggaatataaaaattgtaagccatgaaaaatataaaatctgattcaggttataataacatattaatatcggtttcgttaggtcttgtttttgccggctgttctgatgaagtaaagcagaaacaaccgaatatcttgttttgtatagcagatgatatctcttttcctcatatgagtgcatacggaataccctgggttaatactcccggattcgaccgtgtggcacgggaggggttgactttcatgcaggcctatacatgtaatgcgaagtctgccccctctcggtcggccatcataaccggccgtaattcctggcaactggaagaggcctgtaaccattggccgaaatttccggcgaaattcaagtcgtatcccgaagcattagctgagcatggttattatgtcgggtttaccgggaaaggctggggaccgggtgtagccaaggacagtaccggacagaaccgcgatttgacagggaagagatggagtgatatcaaactggaagcaccgacgaatggcatttcggctatcgattatgcagaaaacttcaaggcttttttcaataatcgtcccaaagataagccgttttgtttctggtatggtgcattggagccacatcggggatatgaatatgcatcttctatcagagcaggaaagtcggtcagccagattgattcagtcccgtccttctggccggataacgaggttgttcgtactgatatgttggattatgctttggagattgagcattttgacagacatttacagtccatcatacaaaccttggaagaagccggggaactggataatacgattatagtcgttacagccgatcacggcatgcctttccctcgttgcaaagggcaggagtatgaatattccaaccatatacctttggctgtaatgtggaagaatggtctaaaaaatccgggaaggacagtcaatgagaaaatcagtgtaattgatctggctccgacttttctcgaattagccggaatcagtcaggaagaatcggggatggagtcgataacaggacgtagttttacagatattctaaaggataatccggtggttaaggaccgcgactatgtgttgattggaaaggaacgccatgatgtcggacggcctcacgaccagggatatccgatccgtggtcttttgagaggcgattatctgtatctgattaattttaagacaggacgatggccggccggtaatccggaaacaggatatctgaacgtcgatggaagtccgaccaagacagaggttattcaaagccgtcggaaacctgataacatttattggaatttgtctttcggaaaacgaggagaagaagagttgtataatatccgtacggatcgcgaatgcatgacggacctggccggcaaggaagaacttgccgaactgaaaaatcagatgcataaagagctactggaacaactgcgtttgcaggaagaccctcgtatcgtggcggatggttcggtttttgatacatttgaatatcaaggtgcggagcggatggtttgggatcggatgaaggccggagaaaaagttaaactgggttttgtgaactctacggatttcgagccggctgctaccggactggaggttgactggagcgatgattagttattaacctattattaagtaaatatcatggataaacagatgtttgtattaccactgatcgtcgcttgggcaacccagggtaatgcacaggaaaaggaatatacacggcctaatgttgtctttatattagctgatgatatgggaataggagatttgggatgctatggacagcaacggatcaaaacgcccaatattgatgcactggcggcaaaaggagtgttgtttgaaaatcattatagcggttcaactgtcagtgcgccttcccggtgttgcctaatgacaggaaagcatacgggacatgcatatgtaaggggaaacaaaggcgtgcagggcgaacaaggttctttcgatttgcatttaccggaatcggaaactaccgttgccgagctttttaaggagaaaggctatgcaacgatgtgtgtcggaaaatggggattaggcggcccgggtactaccggaagccctataaataagggatttgattatttcttcggttatttgagccagggggctgcccatcgctattatcctgattacttgtatgagaatgaagagaaggtctggctcggaggaaaagtgtatagtcactttgctataatggagaaaggattggactttatccgtacgcataaggagactcccttttttgcctactttgcgatcactccacctcatgcagaccttgactacccagacctaagccaatatgatggccagtttgaagaaaaaccatttataagtgaaaagggaaagggctttaaaactcagatgaaacctcgtgccgcttatgcttctatggttagtgaagttgataataatgtgggacaaatccttgccttgctggatgagttaggattaaaagaaaatacattggttattttttcgtccgataatggggtgcattgtgtcggagggcacgatcctgaatattttaacagtaacggaccttaccggggatataagcgggatctttatgaaggaggaattcatgtgcctttcattgtcagctggcctgctgtaatagataagccgcgtgtgactgaacatacctcgacgttttgggattttcttcctaccgtatgtgacttgatagaggttccgacgcctgatggcatcgatggcatttcttatcttccggttttgaaagatcgcgaatcgtcacaacgtaaacatgattatctttattacgaattttacgaacagggagggaagcaggctatcctgaaggacggatggaaactgatccttttgaatatggacgatcaggatcggttggtagaagaactgtattttataaaagaagatatcggagaaaaatataacctgatcgatttgcaccccggaaaggccgaagagttaaggaaactggtatctgcagcccgttcggaaagctgttggtttaattggaagaaaaaatgaaagagatgaataagaaatgtattatatggatcgcagtctcccttcctccgctggccaatagggtctgtgcggaagaacgtccgaattttgtctggtttatgactgaagacgttgctccgcaatttgtaggactttacaatgaaggtaaaggggctcaggctcctaatctggaacgtctggccagggaaggtattgtctttgagaatgcttatagtaatgctccggtcagttcggcagcccgttccactttgataacaggctgttatgctccccggttgggagtcagttggcatcgcaaactggaacaagtacctatgcctgacggtttgcagatgtttccatcctatctgcgggaagccggttatcatacatcgaatgcagcaaagaccgactataattgctttacggataagaaggcctgggatcaggtaaaagggaaaatgggggaatggcgtaatcgcccggataaaaaacaacctttcttttttgtgcgttccaatgctgccagccatgaaagttgtctgcattttgacgatgaaacgatagacacaaaacagacggagcatcatccctcggaagtgaagctactaccttttcatccggatacccggacgttccgttatacctatgcgactttttatgacaagatccgtcaggctgataaagagttgggtacgttgatggagatgttgaaagaagacggagttttggataatacgtttattttctatttcggtgataatgggggaagtttgcccggttcgaaaggatatacaggagaaaccggattacaggtcccgttggtagtttatatcccggaaaagtggcgcgaccgcatcccgttgcctgtaaatagtcgtgcgcatggttttgtcagctttatggattttggtccgacccttctccatctggcaggtgttgaggttccgaagcaaatggatgggacaccgttcctgggagtggatatttctgaaaaggaactgaataggcgggacatcgtatatgggtatggcgatcgttttgatgaattatatgcttttaaccggacagttcgaaaaggaaaatggaagtattcgcgcaatttccaaccttatcatccgaagtcgctttatgccacataccgttataagcaaaaggctttccgggaatgggaacagttgtacaaggaagataagttgactgatattcagaaacgtttctttgaaccacagggccctgaagaactgtatgacctgtctgtggatccttatgaaacatgcaatttggcggcagatcccttatatgccggtgatttgaaaaagatgcgccgtttgcttgccggtaatctcatagcagagaatgatctcggtatgttgcccgaaagtatctggctggaagagggaaaacaaaatccggtcggttacggtcggaaatcacataagcgtatcgagcgtttgatgagggttgcagatttgcagttgctgacgtattcggaagcgaaaggaaaagtagaaaaggcccttgcttcgactgatgaggcagaacgttgttgggcgttgactgcttgtgtctggtggggagacaaggcatccggactatccgggcagatagaagaaatgctgaaagatccaagtgtattggttcaaagccgtgctgcggttttcctggcaacgacaactcgtattaatcccaccggattattgaaaaaagccttgtcgcaagcccgttccggtgctgaagccctttggatcctgaacgatatggcttatttgaaaaatcgctatcctgatttggacttttcattgacaagcaatgatgtccccttaaaatgcgaaggctccgattggagagttgattatttgaaatagttattttatatcatctatctctccatgaaagtttttgagaaataattgttcattccttcatctgtgatgttttttgctattttatcaatgttttacagatgaaggaaatttatttatagttaaatggatagaatctatatgaaggaatgaaggaatatttttctaaaaaagccatcccactctcacgagccgggtggcttataactgctatacagtttcagaaaaaattattaggttttacttcttagttatctctttatatagttcacaatgaccgttcggggcaaagatcccttttcttattaattcactttccagcctgcttaatgatatacacccgaagtatcgatgttcttttagagcagcaagcccattggttgaagcgaacttcaataaatcttccaaggtgtatatatcgaatactttacaagtatttatagtcctcttctccaaattaagacatttggttaatggcttgtttaataacgctttttgtctggtataagggattttggaaggcgctttctttggggcaggttgtttgatttccttctcatccaataacgtctgtaatgtttgtatccttgattttagttgattgatttctctctctttttgaatacggctattgatatggtctctgacaaatcctgactggagacttatatccgtgattgcattttgaaatatctgttttacttcctggggagtgattcctaaatgttccgcaacttcttcgacgcttaacttggtagccaatgcatggaatactatctttttaagatcggaattaagtaagttcctcatttccgatacgatcaataaatactcgggtgacaagcttttaaacgcttcaataatgaaatcactttctttatccttattctcttccggaggttgctcattagccgtcggaatatttacagatgaagatacgacactggcatcttcccatgtcgtcgctttgtgatctgtgagtgcattgctcaaaaaggttggcttctggtcgtcggggaggagaagttttacataatcacgtattttagtcaacaagtttatcataatacaagtgttttatctgaatatatattaacgctatacaatagatactaccctattctcccgaaccggacagttgcagagtcccctcttcactatccctttttactgaattgtatgattgtttaacatattaatgcgttattgtaaaaagtatagcttgaaaaaaggcataaaaaaaaacgtgaaactgttgccgttctcagacctaaagggttatcccttccccctcacactgatagtagacaacagcccacgtcatatcatatataataaatatatacaaacaacatgggcattttgttgctactatctcagtcgtgattaaaaatgggataatttttaggtactgagataatattttaaaatgccttattctaaatatttctacagaacagaggttaacgctataacatctgcactttctgtaatactgcaaagatagtagatacgattaaataaacaatagtttataacgaaaaaatgcctattaggcttaaaaatcatgtgttctgttttacttccgctctttcatttcgctttgaagtagttccggattacgtctacaatcccaaagcatatgaatatatagatatttatcgtggatggtataaattattttaatatgaccggaaactaatgagcggtaggtgagttggtcgatattatcaaggctggtttcacaaaatcccttcaggccttacttatttctttattgcctaattagaattaaatcactaactttgcggcatttttagaagattgataaaaataacgcgatatgagtaagaaatttgccgaatactctaagttcgacttgtcgaacgtcaataaagaggtgttgaagaaatggcaggatggcgacatcttccataagagtcttgaaatccgtgaaggatacccctcgtttgtattttatgaaggtccgccttctgcaaacggaatgccgggtattcaccatgttattgctcgttcgattaaagatattttctgccgttacaagaccatgaaaggatatctggtgaaccgtaaggcaggatgggatactcatggcctgccggttgagctgggcgtagagaaatctatgggtataaccaaggaagatatcggtaaaaagatttctgtcgctgactataacgcagcttgccgccgcgatgtgatgaagtttaccaaagaatgggaagacctcaccgacaagatgggctactgggtggatatggaaaatccgtatatcacctacgataaccgttacatcgaaacattgtggtatctgctgaaagaattatataagaaaggtttactgtacaagggatataccatccagccgtattcaccggctgccgggacaggtcttagctcgcacgagttaaaccagccgggttgctaccgcgacgtgaaggatacgacttgtacggcacaattccatatcctcgatccgaaaccggaaatggcgcagttcggcgatccgttcttcctggcatggacgactactccgtggacattgccttccaatacggctctctgtatgggaccgaacatcacttatgtggctgttcagacttataacccctataccggtatgccgatgacggtagtgctggcgaaggatttgatgggtgcgcatttcaatccgaaagctgccgatttggaattgtcggattacaagatcggtgacaagctgatcccgtttaaggtggttggcgaatggaaaggttcggaactggccggtatgcattacgaacagttaatcccgtgggtaaacccgggtgaaggtgctttccgtgtgatcaacggtgattttgtgactatcgaagacggtaccggtatcgttcatatcgctcctacattcggtgcggacgatgaccgtgtggcgaaagccagcggtgtgccacctttgatgatggtcgataaggatggtaataaccgtccgatggtggatatgaccggtaagttctatctattggaagatcttgatcctgaatttgtacaaacgcgtatgaatgcagccgattacgatccgttccagggcaagttcgtaaagaatgcttacgatccggaaaaaacggataaagacgaaacattggatatcgagatatgtatgatgttgaaggtgcagaaccgtgtgttccgtatcgaaaagcatgtacacaactacccgcattgctggcgtaccgacaaacctgtattatactatccgctggatagctggtttatccgtaccactgcctgtcgcgaccgtatgatcgaactgaacaatacgatcaactggaaaccgcagagtacaggtacaggtcgtttcggtaaatggttggaaaacctgcaggactggaacctgagccgtagccgctactggggtactccgctgcctatctggcgtacggaagacggtacggaagaaaaatgtatcggttcggtagaagaactgtacaatgaaatagaaaaagccgttaagaaaggatatatggaatcgaatccgtataaggacagaggtttcaatccgggcgaatacaataaggacaattacgaaaagatcgacctgcaccgtccgtatgtggatgaggtgatccttgtttctgaaagcggcaagccgatgaaacgtgagaccgacctgatcgacgtttggttcgactcgggtgcgatgccttatgcccagatccattatccgttcgagaataaggagttactggatagtcgtgaggtatatccggcagactttatcgccgaaggtgtagaccaaacgcgtggctggttctttaccctgcatgcactggcaacgatggtgttcgacagtgtggcttataaagcggttgtgtctaatggtcttgtattggataagaacggtaacaagatgtccaaacgtctgggtaatgcagtcgatccgttctctacgatcgaacagtatggttccgatccgttgcgctggtatatgattactaatgcttctccgtgggataatatcaagttcgatatcgatggtatggatgaagtgcgccgtaaatttttcggtacattatataatacgtattcgttctttgctctgtatgcaaacgtggacggattcgattattcggaaccggatgttcctctgaaagaacgcccggaaatcgaccgttggatcctttcattgctgaatacgttggtgaaggatgtggacgggttctatgatacttacgaaccgacacgtgccggacgtgctatctctgaattcgtgaacgataacctgagtaactggtacgtacgcctgaaccgccgccgtttctgggggggaggcatgacaacggataagttgtctgcttaccagacattatatacttgtctggaaacaatcgccaagttgatgtctccgatcgctccgttctatggagatcagttgttctgtgacctgatcaccgttaccggacgtgagacggtagagtctgttcacttgtcagacttcccaaaatatgatgaagcattggttgacaaggatctggaagaacgtatgaagatggcacaggatgtctcttctatggtattggctttgcgtcgtaaggtgaatattaaagttcgccagccgttgcagaccatcatggtgcctgtagccgatgcccaccagcaggaaagtatcgaggcggtaaagaacctgatcctgaacgaggtgaatgtaaaggaactgaagtttgtcgataatgctgccggtattttggtgaaacgtatcaagccggactttaagaagttgggcccgcgttacggtaagatcatgaagagtctggctgctgccatccagagcatgagccaggaaaatatccttgctttcgaagctgccggaacattcacattgaatgtggaaggacaggacgcaacagtcgaactggctgatgtggaaatcatttcggaagatatccccggatggctggttgccaacgaaggacgcctgacggtggctctggatatcacagtgacggaagatttgcgtaaggaaggattggcccgcgaactggtgaaccgtatccagaacctgcgtaagagcaatgggtatgatatcacggataaaattactgttacggttctttcttccgatgaaatggatgaagcgattaaagagtataatgaatatatagcaaaccaggttctggctgtgtcggttgaaattacagatcatgcaataagcgatgcaaccgtgcttgattttgaagacttcaacctgtcggttcgtatcgaaaaggaataatattgaatgaataatgaataatgaataatgaataattcaggaattgtttatatttgtaggcaatagagagagaaattctcggagttttcattattcattcttaattgttaattattaatttaaaaagccatggcagaaaagacaagatattcggatgctgaactcgaggagttccgcgccattattttagagaagttggaggtagcaaaaaaggattacgagttgttgagatcgggtgtaaccaattctgacggtaacgacgtggctgatacatcacctacattcaaggtgttggaagaaggtgccgcaaccttatcgaaagaagaggccggacgtctggcacagcgtcagatgaagttcatacagaacttacaggcggctttgatccgtatcgaaaataagacttacggtatttgtcgtgaaacgggtaaactgattccgaaagaaagactgcgtgctgtacctcatgctactttaagtattgaggcaaaacaaggaggtaaaagataaatgaaattttcaaaaggttggggagcagtgtttattgtaatgctgctccttcttcttgatcaggctctcaaaatttggatcaagacacatatgcagctgcatgaaagtatagagatcaccccgtggttttatctgtactttaccgaaaacccgggaatggctttcgggattgaagtgattggtaaattgttcttatctctattccgtatcgttgcggtcggctttatcggttattacctgtataagctggtgaaggagaagtacagtttcggttttattgcttgtgtctcgttgatatttgcaggggctatcggtaatataatagattctattttttatggagtcatattcgaccatagttttggtcaggtcgcttcacttatgcccgctgagggtgggtatgctacctggctacacgggaaagtggtggatatgttttacttcccgttgattcagacagagtttccggactggttcccgatctggggaggggaagagttcgtcttcttccgtccgatcttcaacctggcagattcggctatctgtgtaggtgtttttctgttgttgatattttataggcatactttgtcggacagtctctcgaaagaaaaagaaaagaaataaatgcggaacaatttgcgcagatatggcgtcgctttgttagtggttactttattggtttcatgcagtaaggttcccgatggaattctctctgaaaaggagatgaaggccgtcttgctcgatatgcagctggcagaggctatgatcaataccgattataagacttatagtgatgatgcaaaaaaggaggcgctttatcagggggtgttccgcaaacataaaatagaacaggccgtctacgacagttcgctggtatggtatggccgtaacctggatatatatatgcaggtgtacgatctggtactggcggaattgaatgaacgtcagaaagcgctgggagacgtacaggccagtgctgctccggtatcgaaacaggattctgtggatatctggccgcgactgacttatcttacctttgaaccgaatgccttgtttaacggagtgacgatcgatatcaaaccggagacaaactatccttccggcagtactttcgtcctgggaatgcgtgtctggggattgaatgctaatatgaagaatcatccggaaattcgcttgagcgctaatcaaggggatacgatcattaccgtgaatgatgaggtgttgaaagacggttatcatgagacgactttgcgtacgctgccgaccaagcaggtgaagagcgtatatggctttatccgtctggatgggaaagatgactcaacctcttatttcaaagtctatgtggatagcctgaacctgatgcggtacaattacgggcggttgtctgctcctaaagactctgtaaacatagccaataaagattctgtaaaataatccttgtatgcgcaggattgcttcgcattatatatactggaagaaatggttccgtatgcattacctcgagttggatgcggaaggatgtttcgtcggtgtatatcctctggaacaggaaatagcaaataccgaattttatgatggtacattaatccctgtaccggcaggtataactgttccggtaggtggaaattttgtgcctgaccaatgggtgtcggcggccgataacgtaacggagggcagtccggttttcgtcttccggttaactcattttactcccgcgacgtctgaactcggcacagacgactgcggtcgcgattgccacattcaacgactctgaggtttcccgctcctgcggatagttggggatatataacttttcgtttacaagtgcttcgatgttcgggcggatgccgtttccttcgtttcccataatgaggatgcctgtgccggataattctttcgtatacatattctctccatcgaggaaggtgccgtacagggggattttcttttcatgttgcgcctgcaggtatgtttgtaggtcggtgtaatgcacttttacatggaccagggcacccatggtcgcctgtacggtcttggggctgaatacgtctgccgtatcctgactgcatacgatatgttcgatcccgaaccaatcggccagccgtataatcgtacccaaattgccagggtcttgtatcccgtcgagagcgatgatcagttggtttgccgggtctgcttcttccagcgaccagacgggacgtttaaagacggcaagtacatcctgcgggtttttcaggaagctggctttgcggatatcttcatcgtcggcctccagtaactctttagctgggatatctccctgtgtcgccatccaggaaggtttggctatcaggaggtcgcattcgaatgcgaccaacatatcggccacgagcttattcccttcggcaacaaatgcatttaactcgttacgaaacttctttaattcaagcgaacggatctgttttactttagatttactcagcatctttactctttttacaaagcaaaagtaagggaatttatttaatttcagctacatttgcgtgcgtaaaagttgaatgatgaagggaatcctccatatactatatttcctatgctttgcttggatactggccgcttgcagtacgacaaaatatgtcggtgacggagaatatctgctggataaagtagaaatcgtttccgataataaatcctataaagccaatgagttgaagccttatctgaggcagcagcctaactttaaggtgttcggactaatgaagtggcagctttttgtatacgattggtcggggcggaatgagaaacggtggctgagtaaacagcttcgccgtattggtgaaccgcctgttattctcgatacagctctggtggatcagtcggcggatgagttgaggcgtttctttattaacaaaggatatgtgaatgctgaggtcgcagttacgatagatacgtccaggcaaaaaaaggcggtagtcacttatcggattaactcgaatgaaccttaccggatacataattatacgatgaatttggatgatccgaagatcgacagtgtcgctcatctgaaagcaccccggcgctcagccgtgtcatcggcttttcgtatttctccggaagattataattccctgataaaggatagtgcactctttgaccgggatgtcctggataaggaacgtcagcgcatcacaaccttgcttcgcaggagggggtattatgctttcaatcgcgactatctggcttatctggccgatagctcttataatcggaatattgtggatctggatatggtcctgaagccgtaccgccagcttaaatcggatggttcggttatcgatacgctgcatcgccagtattatataaaggatgtcacgatcgttacggattatgacccgttgaatcaggtgcagagtgatttaaaactgacttcgtccgatacggtgaaagtcggtgatctacagatattatatggtaagagcggaagaagtattcgtccgagtgttttgcgtaagagtacttatattactccgggtcgcctgttcaacgagcggggggtggaacagacttattcttcttttgccgctcttcgggcactgagaaatgtaaacatacgtttttcggaagtggaggaaggggatacgatgaagctgaattgtacgattctgacttcgccggccaaactgcaaggctttggtgtcgacctggaaggtacgaactcggccggagattttggttttgcttcgagtgtgaattatcagcacaggaatttatttaaagggtcggaagtattttctgctaaggtgcgcggtgcttatgaagcgttgtcttcccagtcggatggaagtagttattgggaattgggggctgagtcttccattttgttccctcgctttttgtttcctttcataagtgataattttaagcggaagattcgtgcatccaccgaatttaaggttagttacggtattcagacacgtccggaatatcgccgtgctatcctgtccggagggtggagttatatctggcaggatcgttcaaatatgcaggcgcgtcatacatttaagttattggacatagattatgtgcatatcccgaagatcgattctacttttcaggcgactttgcctgagtcgatgaaacgttataatttcaccgaccagtttgtagtaggctccggatatacttattcattcagcaattataatcctcagaaccgattaagaaatacgcattcgttgcgtgtatcgtttgaaatggcgggaaatatgctttatgcgatttctaaactgacaaatgcgaagaaggatgaggatggcctgtatcgtttattcggtatcaattactcccagtttataaaaggagatgtcgatttcagtagaagtattgtgttggacagtcgtaataaactggcttttcatgcgggagtaggagtcggctatccttatggaaatgcgaggatgttaccgttcgaacgcagttacttttcagggggtgcaaatagtgtacgtggatggtctgtccgctcactggggccgggaagtatgaagatcagtccggatggtacttttgccgaccaggtaggtgatatacggttggacctgaatatggagtatcgtacaaagatgttctggaaatttgaaatggctgcttatgtggatgccggaaatatctggactatgcacaaggacaaggatcgtgaaaatgctaatttcgatttttcccgtttttataaagagatagctgtctcttatggtttaggtttgcgtcttgatttcgacttcttcctgattcgttttgatacgggtatgaaggcgtataatcctcaggaaaggggtaaagatcgctgggctattttgaatcctaatcttaagggcaattttgcctggcattttgccgtaggttatcccttctaatgaaaaaaaaggctttccggtttgcatattaaaaaaaatagtactacctttgcaccgcaaataaggatggttccgtagctcagctggatagagcaacgcccttctaaggcgtgggtcgagcgttcgaatcgctccggaatcacaatttgagaaacaccttgcaatttaatgttgcagggtgttttttttatatataattcgataggccgtttaagcaaaataaagaattaaatttagtgtttaatgcgtgaatattaaataaaagattgctttattaaggaaatattgaatctttatgtatctttgatctctgtaaaaacaatcaatgaatttagggatgagcagtaacaacgacgatattttattgctgaaactgataaagcagggtgatcaaatcgcttttaagcatttgttttatcagtataccgattcgttggagcgtttcattacctattatattcatgaccgggaaaagtcgcaggagttggtattggatatttttacttatatatgggagaatcgcgaacgttttgagataaagttaacattaaaagcctatctttttcaggctgcccgtaataaggcttttacttatatccgtgataaaaaaatcccggtttatttagaggatctctctgtcagtgaagtggcgcaagattataattcggatctcgaatttcaggaattgtaccgtttggtagaggaggccgtatgccttttaccggaaaagtgtagggaggtattcaggaaaagtcgggaagagaatttaaccaataaagagattgccgaacaacttcatatttcagagaagacggtggagggacaaataacaatagcacttaagaagatcagagtttatttgggagattcttattcatatttgtggtgaaaaaaactttattttttaggggatacagcgttcttttgagtctatatttgtaaaagaaaacgttttataaataattctcaattccatgaataaattattgttactatttggggtattttgggggataggagttgcttctatccacgggctaaatattaatttggctgatcctacgatcttttatgaaaacggaactatgcgttatgtattccacatccaccattcgaatccgggagtggctcccagacaaacgtttttcttcccgcaattgataaatcaataaaccttccggcacactgtctatccggaaataaaataattatattatgaagaaaagtatattgttcctttctctgatttgtggtgcttgtacggcaccacaagacactttagtggagcaggttgatagattatcaacttcaacacagaatgattattatgtgagtaacagggctcctttacaaccgcaacaatttattaaactccctgccggtaccattcagccggaaggatggttgaagcaacaactggagttgcagaaaaatggtttgaacggacatttgggagagatcagtgcctggctacaaaagaaggataatgcctggttgaaaaccggtggacagtggggctgggaggaagttccttattggctccgcggatatgcaaaccttgcttatatcgttcaggataaccagatgttgaatgaagctaaattctggattgaaagtatcttgaaaagtcagcgggaagatggaaacttcggtccaatgcatctgaatgacggtaaacaggatttttggccgaatatgatcgtcctgtggattatgcagtcttattatgaatattcgaacgatgaacggattatcgattttatgacaaagtattgtaattatctgcttactgtaccggatgaagatttcttatatagttattgggagaatagccgtggcggagacaatctttggagtgtcgtatggctatataatcacaccggatataagaatttacttacgctaggtgaaaaaatacataaaaatacggctgactggacgaaatcgactcaattacctaactggcataatgtaaatgtagcacagtgtttccgtgaaccggctacttattatctgttttcaggagattcttctatgttatcagccagttataatgtgcaaagcctggtacgcagggcattcgggcaagttccaggaggaatgttcggggcagatgaaaatgcgcgtatcggcttttttgatccccgacaaggtactgaaacctgcggcttcgtggaacagatggcttctgatgaaattatgcttcagatcagtggtgatccttactgggctgaaaactgtgaggatgtagcatttaatagctatccggcggcgttaatgcctgattacaaagcccttcgttatataaccagcccgaatcatattgtaagtgactctaaaaatcatcatccgggtattgataatagcggaccatttctttctatgaatccgttcagtagccgttgttgccagcataatcatggcttcggttggccttattataccgaaaatcttatttatgcgacatcggataacggaatggctgccgtcttatataatgcttgtcaggcgaaagtcaaagtcggaggcggaactgaagtgacaataaaagaacaaacaaattatccttttgaggaaacggttcgttttactttgacgactccggaaaatgtgacattcccactctatttacgtattccgtcatggtgcaaagatgcatcggttgctgtgaatggtcagaagctgggtgttgatttgatagctggtaaatatgtaaaaattacgcgtgaatggtcggatgcggatgaaatcgttctcacggttcccatgacatttaattatcgccagtggcaggttaataaaaatagtgtcagtgtcgattatggtcctctgactttgtctttaaagatagatgaagattatcaacagaaagacagtcgtgaaactgctatcggcgattcaaaatggcaggagggggccgatgcctctgcatggccaacttatgagatttatccggcaagcccgtggaactatgctctgcagatcaatgctccaatctctgttctacgcaaagagtggccttttgataataatccatttacattgacaaatgttcctttgatatttaagacacagggacgtcttattccggaatggaagatcgatgaatgcggtttatgcggtgtgctgccatatgaagatgccaagaaatcagatacattagatgaaataacattggttccgatgggagctgcccgtctacgtattgcatcatttccgacaacggaataggaattgtaatcgatttctttagctatgaaacttattttgtacggattatttatgtatagaaagtatatgtaaatattggaatcttctgtttatctttgcttcgtacagcaaaaggaaagcgtaaccggctgtacaatgtacgagtaaagcataagcgtttaagatactatccgattctgaaatctggacaatttcactatgaccggataaggtacaacaaacgttcatgctcttttcttgttatatacctaagttattgcgtataccaagataaagagcgtgggctgttgtatatattggtcataggggcagtccagagcctcagaatcgatatgtcaacagtttccacgcttcttttttttattatccaattcggaaactggtggatctggtaaccgttttgaatatgagcaatttatcttcccatgatcttcccggatcaaattttttcaaagaaaaacacaatccttttagggggtagctattctttttgagtctcacgatgtataagatgcaaaaaatggatagaaacataccttgggatattataataaagggatttaaacatgaaatctcgttagaagagcaaatcgatttggagcgatggcttgctgacgagaaaaatctatctgtatataaagatttacaatctctttggttgactataatagaagaaggtacgacttttgaatcgaatgtggatgctttatgggcaaagatggagcttcgcatgaagaaaaatgaacctaaaataataaaattctcgcaagcttctttccgttggttctccggggctgcgtgtgttttaatcctcgctttattgtctttaaccggatatatctctcttgaaacatataaaggaggaccagtttatacttattcttctctgacaggcaaatcgaaagtaatacttcctgatggttcgcaggtttggttaaatactgaatctacgttggaatattctgcttcaatctggaataaaacaagaaatgtaaaattgaagggtgaggcctattttgatgttaagaaggatccggatcgtccttttatagtcaagagtaataattttgatgttagagtacatggtactacttttaatgtggcagcacgtgataatgagccgaatataaatgtaagcctgttgtctggatctgtagttgtagccaatggttcagtatcaaaaaagatagtaccgggtgaaacggctgtctgttccaaaagtcaaggcagtatcctgacaaagaaaaatgatgtcctttttgctgccatgtgggcgaatgagtctattcattttgagcgtaaatcaattaaggaattatccaaatatttatctaaatggtatggtgtaaagattatactggaccctcttattcctgaagatcaggcttatactttttcgatcaggcatgaacctcttgaagagatccttcgtttaatggcccggacaaatcctatccaatatagttttgatgaaaagaatattgtgaaaattatgaataagtaaaacctttaaaatcaaatgcctatgaagtaacaggaaagaaaaagtaataatgttttaacctttttattaattaatttatttcgataataatcttaaaataagagcttatgaagaagcaaatgttttatgaggccagtgggaaaatctggagaatccccttgtttatcggtctctttttccttgcctctagtttgtatggatactcaaacgggcaagcgaaatctttctcaattcaattagaaaatgtattgttaagtgaagcgatcgaccagatcgaaaaagcgagtggttactcttttttttatgatgagaataaaatagatttttctcatcgggtcagtgtaaatgcaaagaaccagactgtagcaagtattttggatagtattctgaaatcaacgggattagattatgagatttcgaataatcagatcgttttattgccggcagagaagaaagcaacaagcaggaatggatcaggaccaattgcaacaaaggcacaacagcaaaaaactacgataaaaggaactgttgtcgataatttgggagagcctgtaattggggcgaatgttgttgaaaaaggaacaacaaatggtaccattacagatatgaatggaaacttttctttgagtacatctccaaatgcaactttggaagtttcatttatcgggtatataactcagcgtacaccagttaagggctcaactgtaaatataacattgagagaagatgcgcaggctttggatgaagttgttattaccggtttcggtatgtcacaaaagaaagaatctctgactagtgcaatttctttgattgactccaaggatatagcccgttcttctgcatctacatcttctggtgcattggttggtaagattgctggtgtgaactctcgtcagacggatggtcgtccgggggcaagtaccggtcttcagattcgtaatatgggtactccgttgtatgttatagatggtattcagacagacgaaggtcagtttaataatattgactttaatgatattgaagcgatctctatattaaaggatgcttctgcttctatctatggtgtacgtgctgccaatggtgtagtagttgtaactacgaagaaaggtcgcagaaatacaaagaatacggtaactattaacgcacgttatggctggcaatctgcatctgcattccctaaaccggcggatgctgcgacttatgtttccaattggatacaatcagaaacattacaagggatcaaggagcagaaccgtaagtacacaatggaagatttggcgaagtggcaacaaggaactgaaaaaggctatcaatcatttgactggtatgattttatctgggaaacatctcctcagtcttatgtttcagccaatgtatccggtggatctgataaggtaaattattacttctctttaggatatatcgatcaagatgctatgattcgtaattatggtggtttcaaacgatataatacgcagatgaatattgatgctcagattactgaacgttttaaaatgagtgcatctatgaacggacgtatcgaatcgcgtgtcaatcctggtgttccgggtggtgacgactattggttgccggtatttggtacttatcgaaatctcccgacagttcgtccttttgcaaacgataatcctaaatatcctgcattaacatccggtaataaggatgtgaacttcggtctgttgaattatgacatttccggtaaatatcaggatgactggcgtgtaatgcaacttacattcaatggtgaatataagattatcgacggattgacggcaaaagcccagttcggattctattatggtcagcgtgaacaaaataatcaggaaaatgaatgggacctgtatcgttatgatgaagataaggatgagtatattgttgtggatggtatgcataacccttaccgggatagaacgatcaaaagagttcaggatattacaacaaatattcagttgaattacaagaaaagttttgacgatcatcatatcgatgtaatggcaggtatggagtccattaaacgtgatcagccggaacattttatccattcaactccaacatccaatacattacatttaatagacgtagatgaaattgtagaatttaatgattatggcaatagaacggaagctcgcctgggttatactttcagagccaattatgattttgcatctaagtatctgttggaattctccggacgttatgacggttcgtggaaattcccgcctaatcaccgttggggattcttcccttcgggatctgccggatggcgtatctcggaagaaagtttctggaaagacagtaagttatcgaatatcgtaaatgattttaagatacgtggttcttatggtttattaggtgatgacaacctgggcgattcttataaagagtttgattttttgggaggatataactacaaagatggtggctcgactatcgatggcgcttatgttgttggttctgttccccgtggtctgcctgttacaactatctcatggataaaagcaaaaatactggatgtcggttttgacgtatcgttccttaacaatcgtttgtccggtcagttcgactttttccgtcgtacacgtgatggtttgcctgatcgccgttatgatgtgttgatcccggctgaagcaggttttgacttaccttatgaaaatctgaaatcagacgtacatacaggttatgacctgtctatccgttggaatgataatgtagaagatttttattactcaatcggagcgaatatgacttattcacgcttcctggattggaatcagtataaacctcgtttcggtaactcatggcattattatcgtaattctattgatgaacgttatggtaacctgaactggatgctggaatctgacggacaattccagagttgggaggaaattgctgcctggccgattgataacgaccgccagggtaacaaaacgattcgcccgggagatattaaatatgtcgatcagaatggtgatggtgtaattaacggtatggatgaacgtcctttaggatatagagaaggtggtactcctattgtaaatttcggtcttaacttcagcttccagtggaaaggttttgacctggcattcgacttgacaggtggtggtttgaatagtagatatcaggattatgagcaacgtaatccgttccatgacggaggtaataatgcacagtattatatggaagatacctggcatttagctgatatcacagatccgaacagtactttgatccccggtaaatatccgactttattgatcggtaactccgggcatagtaactattggaagagtgatttctggatgcataatgtacgttatatgaagctgagaaatcttgaattcggttattcattgccgaaatcgatactggctaaagcttttattactgatctacgtttgtatgtatcaggacagaacttactgactttgaccaatactcatggtatagacccggaaatagagaattcggcaggtctggcttatcctacaacacgtattgttaatttaggtcttactcttaaattctaattagtatgaaaaagaaatatatttattctgcctgtttagcttttacattggcattttgcggatgttccgatttcctggatcgggatccggaccgtatattgtctgatgaacaggtatttagtgatgaaaaaatgataacctctgttctggcgaacttttatggtcgtatggaatggggacaacgtataacagatgtcggttcttatgtttgtttggacgaagctttacgttcaagcggaggccctgatttattccgtacttttggtgacgatcactggcgtatttatgattatggattgatacgtaatatcaaccagtttctggccagtttgaataatacggatgtcatttctgaagagagaaagaatcagcttcgtggcgaagtccgtttcttgcgagcctatacttatttctgcatgtgcagatgtatggggggaatgccgattgttggcgacgaagtgtttacgtatgaagcgggaatggatatcacgtctttgcaatatcctcgttcgacagaagcagaactgtatgattacattattaaagaatgtactgaaatatcagcggatggcatgttaccatcagaagcttccaagaattcagcacgtgcaaccaaatgggccgctttggcattaaaagctcgtgcagctatttatgccggttctattgccaattataataacaaaatggagaatccggtttctactccgggtagcgaagtcggtattccggcatctaaagcttctgaatattataaaatagcatatgatgctgcgaaagcagtgattgatggaggtgtgtatgtgttacagaataacatatcagataaagctgataatttctatgcagcaactacattgaaggatggtaatacagaggtgatctgggcacgcgattataaaggcccgtccaattatcagggctggactcgtgataatgttccttcttcacatgccgaagatatagaccaggcatatttagggccggtactaaatctggtagaagattttgaatatatcgataatcgtgatggaaagctaaaaatcaagaattctgacggcagttatatcgcttatgataaggcgatagacctgttcaaggataaagatccccgtttgtttgctacagtaatggttccggggtcttctttcagaggttccgaagtcgtattgcgtgcaggcgttaaacgtaatgagggcggcgagtggaaaagctatcatggtaaacgtgggcaggatgtaacttcaagaggtttggttatcactccggtaaatggtccgatgacaaccggtgacgaccaatatgtaaacaaatcaggcttctttgtcagaaagtttatggatgaaacagtcggtgcaacgacccgtggccgtggttccgaagtatggttcccccgtttccgtgtatcggaaatgtatttgattgctgctgaagctgccatggaaatgaacgatcaggataatgcacgtcgttatttgaatgcagttcgtgaacgtgcaggtatccaaccgttgagcgggactatcacattgaatgatattgttcgtgaaaatcgtgtggaatttgcttttgagaaccatcgtttctatgatctgaagcgttggagactggcagataagctttgggataacaatgataacacttcgacagctgttcatcgtgtattgttcccttatcagattgatcaggtgggcgatccgaatgatttgaaatgggtttttgatgctacaactacttatatgtctccgtatcctcgttatttccaactgaagaattattataactttattaaccaggattggattaacaggaatcctaagatggtgaagaatccgtatcaatcttaattaaaagtaatgagaatgaaaaagataatatataatatagcctcattattgttgttggctgttttcgccactagttgtggtttggataattacgatgcacctgaatctaagttgtatggtcagatcctgtacaaagatgccggtggcgtagaacatcctttacaggttaaaggtaccggagaagccataaaactttcgttatatcagtatggctggcagttatcagatggtattacgttgtatgccgatcaggatgcaaagtttgaagccattctttttgacggcgattatcacatgattacaaacaataataatggtccctggaaaactgtacagatatctgaagtaaaaagagatacggtcgattttacattgaagggaagtactgaagtcaagatctatgtgactccttattttatgatagaaaatgcatctatcagtctgaatggaacgaatgtatcggctacctgtgctgtaaaacagattattcctgatgcagcggtaaatacgcaaagtgtgtttatcagttctacccggtttgtggatgagcagacgaatttcgctcgtatggacttttcggaggagaagtctgccggaaataaaaacttctcattcacgataacggatgcatcacagctgaaatcattggagaatgcaaagaatcgtacaggtaaagtgtatgctcgtataggtgttaaggcagaaggagcagatcaatttatttattccgaggtcttcgaactttcggtaaagtaaatcgggtcatctaaagttaggggctgtccgaagaatcggatagcccctttttttaacaagtgtatcttaaatagtttatattatgaagaagtgtgtattaatttgttttaccctctgttttttagggggagtgtttaacatgaaggcccagagttcaaagaacttcaccttgccaaccccctggacggataaagctttgcaagcatctgttcctctgccggaatatccgcggccacagatggtgagggcagattggttgaatctgaatggtatgtgggattatatgggagggaaggagttgcaggatccggtatcggcgactaccgttccgacgtttcctgctaagccggaacagatccggattccttttccgcctgaggcagaattgtcgggtattgctcgtaaaggagatacttgtttatggtatcgtcggagttttacgatcccagcggagtggaaaggtaaaaatatcttgttgaattttggtgcggtagatcgtatttcgactgtttttgtgaatggtaagaaggtcggaacacatacgggaggttatgatgcctttacttttgatatcactgatttcctgaagtcgggagagaactcgcttgttgtcggcgcctacgaccccaacgatggaagggcagcctccggtaaaaacggaccccgtggcgattatacctttacctccggtatctggcagactgtctggttggaaccggtggagaaacaatatgtttctcaggtcaaactgatcccggatctaaagaataaccgtttggaagtgattgtttgtgcagataacgacggattaaaagtttcggcagtagctaaagacggtgtgacggaagtagcgaaagcggaaggaaccgttaataataagttttatatccctatacagaaccctcgtctctggtctcctgaagatcctttcttatatgatttgaagttacagttgaagaatacgaaaggtaagattgtagatgaagttgcatcttattttgggatgcgttccgtgtctttgggaaagatggaaggagtaaaccgtcctttgttgaatggtcagtttgtatttcagataggactgctggatcagggatactggccggatggcattttcacggctcctacggatgaagctttattgtatgatatcgaattggccaaacgagccggctttaatgtgatccgtaagcatataaaggtagagccgcagcgctggtattatcattgcgaccgtctgggattgatggtatggcaggatatgcctaatctgtgggaaccggatgatacggattctgttgctgtccgtaagcagtttcgtgaagaattgaaggtgatgatcgatcagcatatcagttcaccctctattgtgatgtgggttctttttaatgaaaactggggagcgtttgaagctaccgatataacggattgggtgaagaaatatgatccgagccgtctggttaatggtctgtccggttacaattatgctccgggttatcgtccggcctatggcgatccgggtaatggcgatttcgtcgatctgcatcattatggtaagatagagccgaaggcgatgcctcgtccggatgagaagagggcggcatctctcggtgagtttggtggaaaaggattgtttgtcagagggcatttgtggcctgtgcggaatgatgcctatgaaatgatgttgaataaagaggttttgactgacacctatattctcatgcttaacgaattagagcagatgattaaatatttcggcttgagcacggctatctacacacagacaacggatgtggagcatgagataaacggactggtcacttacgatcgttgggttgagaagatgaatctggaaaaggtcaaacaaatcaatcaggaggtaatagaaggtacgcgacaaaaataagtagcatgccagtgtaaagaaggtagcactatagtgctgacgaacctgagtctatagtgctaccttatcctttagctgttgtttgaataactgttttaatgaagcgaacctgtattttcatccaggctgaatacggaagacatggtttgtatcccttcctgatcctttaatgtacagaggatgtttttatccctgtctaccagaaacagatgatcccgtttgtccggattcacatggccgacccagtttgtgaagagcaaacgcccgtcggggaaatattgcatacctcccagaaactttaaaggctctccgggaatatccttgttcgatatttcccatacggtgttgccttttttgtctaattcgacgatacggggattctgtgtcttatcggcaacggcgaccagtgtgtggccgttcggtaaccggatcacagaatgaggaccgccgggaacctgtgcctgccagactacttccccttttgaatcgtattctttgacatattcccctccgtaatgcgctacaagataattaccgttatccagtttgcgggcattacgcataaaggcaaatgttccgtccgaaacaccttccggcaggatgcatacctcacttacgatttttcccccgggagaaacttccagtaaacgtccggcattgcattcaccgataaaagtattcccgtttttcagacgctggcaggcgaagacgggactttctgatgcgtaataaaagacggtatcgttttgccgggtcacttccagtactcctttaccaaccgaaaacaataagttcccattcggaagtacccagagatcattcgattccggagcctcatgttgccagacgatcttgttgttttccataatgaaaacgatcccctgggaataatcggctccggcaaagttcccgcattgtgccagtacactaaagcagtgaatgcaggaaagtacaaatatataagcgaaatgtttcataattctttttttatagtgataagacatattctgccagatcgccctgttctttatctgataaagtttcggcagggccgtggactttcagcatttccagcatggtataactgcgcccgtcatacagatagggggctgttctccatacttcgttcaaggcgggaacatccattttcacattcttatccggtccgttcgtccagtttaccttgtactgtttcatatccgtataataagttccggaatgacaggacgcacagttcttctcgaaatgttctttccctctttgggcggcttcggataaattaccgtttaccagataagggcttggaaccggtgacaatgacttcaggtacacatcgatggccggagctatttcttctgtcgaagcagcaaataagatatacttgatacctgagataacggccgtttctgcatctttacgaataccggaaaccatgcagggaggagtctggtgggataaaaccaatgtcttggtattcttaggattccccatgccgtcgttcagcaaatcccagttcagtccgtccatgcgggcatcgttggggtggcaactggcacagctctgccattcctggaagccgatggaagcatcgtggaaatacatatcgcctttccctttttgagtggatgcgagtgccgtacccaatgaggaagaaaccatatccttgccgtttccgttgaaggcaaccaactctccggtataataattcgccgtatagactttatccggtgtgacgtacagggcacggggacctttcccctgcgttttgtagaaatcacgtatgccgtataagaaaccggcatcatccgggatatgcgcgtaatctttggttgaaggagttactttttcgccctcttttgcccgtgccaggcggtcgtgcaatgcgattctgtctacacataccagttcgtgagatccggagacagatatccatattttactatcatccggagagacgataacgttccacggattggaggcgcctttctgcggagtgtccaacagaactgtattctccacttcctgtgtatgcaggttgatgacggacaggacattcgtactcatccatccccggtctacctggttggtagggagctggtagcgtgccaataaatggacggcatatgcgtaattgcctttgctgtctgtagctaatgcttttacatctgtggaaccgtttggaagctgtaagcgtttcaccacctttttattgtttacatcgacaatatccagttggcaggcaatcggataagtgagcgatgacatttccggcaggttgttggccaccagtaataagctgtctccagcgaatgaaacgatgtctaccggttcgcggcctacgctgattcggttcaacacttcttttgtctccggagatatttcccacagttcattattgaagcgttgggttgtccataaagaacctgtctgccggttgaataagagggcggaaggagtatgtcccaaggctgtttgagagataacggacaggtctttcccatccaactcgcataaagagcctccgacgccgtcgcataccacccagatatgccggtcgggcgtttccgtcaggtcgttggcggcggttggcaatgttgttttgatacctgtattctttagatgggtatcgatgaggcatatttcttttttatcccggtttgtcaccagaagtccgtcttcttgtccggcactccatatatgatcgggggcaaaaacatcatttccgttgcatcctgtcagggcaatgaggcacaggcaggctatataagtccagtttattttcataatctttacttctttgcttttaatgattgaagatactgacggatgttttctttctcggcagcccgggatgtttcccgcttcttctcataatatgtatagtaatccttctcctcctgtgtccagttgtttgcttcccggtagtcaccgatgaagggcacgcagaggtcgatccataaagcgatcgtttccatttcttctttattcaggttacatccgccgtgtccgttctctagccgtttgatcaggttgctagtgttggagccggcaaaataaggggcaagcaatgtcggttcggacaggttgcttatccagtttacttccgggtgatgagcgtctccctgccaggagtcgttgccttcggtcattttacgcgcgtgagtcaaattcagataggagtctgagaacttgcgctttgtttgctggtcgactactttcaactcgcctttcaggctcagcttgcttttcactccgtcatgacaggatatacaatgggcatcccagataggttgcacttctttgatatagctgaatgaacggtctccaatcccttccggctcgatcttttggataccggtgttcatagccatagataccggatgtgaagacagcggcactgtattcttgtgttcatggcatcctacgcaactctgtgtttctcccggctgcaaggtcgaccagctacgcatggtctgtacaacccggttgttttcatccaatgcctggaagtataaaggtgtgcggcaaggcactgtgaagaaggccgaaccgtccggctgcacatctaccgtaccgagtatccgtttaacatcccagctggcattaccgactcccaccggagagaaggcatgtccgccgccccctgcgtcaaagccgaaagcggcaccgatactggctacacggtagatgggttcgacgatacgcagtttcttgattgttcccggccggatacctttcaaaccgttcccttcgtaaatattctgcatatagtagacaccttcctctttcgtgtaatccacattgtttacacgctcgaaaggacgttcatgttcggccagcaggacaggctgattgcaggacaggctggcatccgaaaccaatagttcgcgttctccggccggtgtcatccagtagatgccgaattccatcgggtgacctacatgatagcccagcggcgtataggaaatcaggaactcttcttcattcaaggggtaagggtgctggaactgatcgccgaactgtccgtaggcatctacttttacagcttccggcctgtgaagcggggcaaccagcataacgccttcgttttcatcacgtccggcttcgggatcgatgatgcataatttaccgtgttgaggggtgtgatgaccgaggatggttgccatcacctttcgtgtcccggggatttgacgggtatgcgtgacggtggtagggaagaagctgtttcctccataatactcggcctgtccggtaccgtccgggttcatctggcagagcggttgcataaatacctggccacggtcgttgtattcccaacgggtatagaccacgcgaccgtcgtcgagcagtgtcggattggaggtatgtacctggtcgaatccgacttgccgcatatagcgtccttcgcggtcacagagatagaggttgctgacttctacggtccagcaatctacggagctaccgttgcgggtcgagttgaacatgatattttcatccggcaggtagataggctctatgtctgcaaatccgagaccggaggtgatctgttttagtttccgcgagggcatttccatttcatacaggtggaagtcatcttctttctgcgacttcttccatgaaaacaatatatgctttccatcgaaatgtacgtccggatcacggaaaacgccggctgtatctttcaataaagtttgttcttttgcccagatgccatccattttaaagtatcccaactcgcctccggcaaagaaattgcattctgcacgggcatcggacaaaccttccgtataggcaaagaaagacggacgcagtgtacggaatttggtaaacacaacttcgggagtactttttataaatgaggccagtcgctgttcccttcttttcgtacaggcatcgaggtaggaagacaaagcctgtgtgatgctttccggggtgtcggttacttttgtttccagttgcagtttgtgcaggcgttcgttgatctgactggaaaaagtcccgtcaaaccatttcacattgcttccatcttgtagccaccagtcgtaatagaccggataatgatgatataaatgcagatgcgcctcccggatcagggttgcggtactatcttttgagacaatcccttcggttgcctttattttattgaattggttttgtatttcggctataaattcctgcttatcgacaggatggtgatccttatacgtcgtttccttgttctggcaggctgccattacaacgagtataagtcctattcctattttgtgtaagttattcatgatactcccttctttgttaataatccggttaccggaatagactgaaacgatgctttgtttcagtttgtttcttccgggtgaaactattgtttctcttaggtgaaactattgtttcatccggaagaaactttagtttcacttgcgggaaactttgtaggcctctacgattgagactccgctagacgtaccgatgcgggtagcgcctgctttaatcatggctaatgctgtatccaggtcgcggataccgcctgcagctttcactccgatttcagggccgaccacgcgacgcatcagggcaacgtcttccacggtggctccggctgttccgaaaccggtagaggtcttcacgaaatcgacacctgcttctttggcgatttggcagactgtttccttttctgcatcagacagatagcaggtttccagaattactttacagatcacacctgccggacggcagatggttaccatatcttcgatttctttctttacgatatcgagccgacctttctgtagggcgcggacattgatcactgtatcgatttccgttgctcctttttcgatggcatcgcgtgtttcgaacgctttgcattcggtagtcgtctggcctaacggaaagccgatggctgcaccgacacgaacgggcgaaccttccagtaacttaacgcaggtttctacttctgccggattgatggctaccattgcgaattcatatttccgtgcttcggcacaaagcttttcgatgttctctgccgtgccgaaaggtttcaggaaggtatggtcgatcattcctgctaattgttctactgttaggtttgcgattatttcgttcatgataaatgatgtttagaatgttaatactgtttttattacttcgttacgttttacggcttccagagcctcgtttatttgttcaatcttaaagcgatgggagataaagtcggaggcagacaaccgaccttcgcgtatccactcggtcagtgcaatcatggcccgtttctcttccgaacgggtcggccagcggtggatgtagaggttgaagttgtacggagcctgatctaaatcgatcgtcggatttttggtcatcacaccatagacacagatgtcgccggccattttgataagcggcagagccgagttaacgatggatggcaaaccgactgcgtcgatgatcgtgtcgtacgaacggttggcggccgctataaattcagggttggcgatttctgccggagtatacccgttgtcggctcccatctttttggccagttccagtttggcgggaagcatgtcgacgatatctacctgtcccagaccgaacagtttgcctagtttgacgaaactcagtccgacgggaccggcaccgaataccataactttcttgcccggagccaggcggaagtctttaaatgcaccgactatctcacgccaggtacaagcgattactgcttcttccggctgtatatcggcaggtacggcattctgaatttcaaagctgtcccagcaaccctgttccggtgtggcgaggccttcttccttcaatacttcgaaatcgttcacgacgacatattcactgaaaccaccccaggcactattcaatcccggagttgtaaaagtggcattcaatccgccgatggccctgtcgcccacacggaagttgcggactttcgccccgacttccactacaatacctacattctcatgtcccaaagccatcgggaactggtctgctccgggaaaatgcccggatatcagtttactgtcagttgcattacacaaggctaccatctcagttttcactaaagcctgatagggtgtgatagccggtatatctatctcccggatctctactacgccgggagctgttgcgattacgcttttcatttgtcctttcatattctttcttatagatttaaattcgataagtcggcatagacttctttcaaatggtcgtacgtcttatcgaatactccgattaattcctgatatttctttacattggcagggatagggctgatcttcttatcgatatggataaagcggtcggttacgctgaagtccttgaacagtccggctccgataccggccaggatagcggcacccatcgaggtggcttcttccaggtagttcggtatctttatttctgtctgatagatgtcggccatcatctgttgccagatgggatttttggcacagccgcctatcacggtcatattctcaaccggcacgtggttgcggaatatatttacgatcagtcccaggttgagggtgataccttccatgacggaacgaagcatatcggcatgcgtatgtcccacagtcagaccgataaaggcacctttggcatttacattccaacgcggagaacgttcacccatcagatagggcaggaacaatagtttgttggagcctatcggtgatttccggatctgttcgtcgatcagttcatatacatttcctttccggagacgggcctcttccagttcctgcctgcacagttgctgaaccatccagttgtagctggctcctgccgtttgcatggtgccggacggatgaagcataccgggtacgacatgcgcccagttcatcgtgcgccgttgttcgtcgacaacgggtttttctacggtcagagccacccatgaggaagatcccaggtagttataagatgttcccggagctacgcatccaacgcctactccggcacaactgccatcgccgcctccgcaaatgaccggtgtcccttttcggagtccggtagctttggcagcctcttctgtaacttcgcctattacgtcgatggaggaacgtacttccggaaacaatgaaatgtccagtccggcggcctcgatgatctcttcactccaggcccagcgattcagatcgtaggcattcgtgccggaagcatccgacggatcggtggctatcgtgccgcaaaggcggaaattgatataatcctttgcattgagcatcttataagtattcgcaaatacttccggctgatgtttccgtatccacatgagcttttctatcgaataagaggcactgatgcgatggcctgttatctcgtagaaatgaagcgggtcgatttttcctgccaggaacgcttcctcctcctgcgaacgctggtcgcaatataataggtggggatacaacggatttccttttttatcgacgcataaacagcccatcatttgtccgctcagggcaaccccggcaatatcttccggtgaaacgatttgcagtaaagcgttggttgtttcaacgatcgccttccaccagtcggcaggattttgttctgcccggttgccggcagcataatcggtacggtaagaggcaacatgggaggcaaccagcataccttcttcgttgaataaagtcgccttgttaccactcgttcctaagtcgtgtgcaataacgtattttgacatggtctatagaatattatttataatgcagcattcgtatatccggtcagtccgaccagaatacctccaacgattcctccggctatgataaccacccagcgcgggaatgcttctttcaataagcccgggcgctgacctttcggggcacagagcgtatcgcaaaccacaaatcccatcgcaatggcccaacccatatctacccacggagcactaccgcgtgcaccttgatgaatcaggctgaactgcatcggcagcccgtttgcatccagggccaggccggtggagaaaccgaagccgggcagtttatggtttaccagccagaatgttcctataattaatgcggcggcgataaagcccccttttgctccgaagtctctgaccagtttaggccagcagaatataaccgtgaatgtgacggcgaaagaaccgaatatactcgtgatgataccggcattgtacataccgaatagttcattgtaagtctgtaaccactcgctcatacagcctcctcctcttttgacaggcggttaccgcatgatcgcatcgcccagatggtcagaccggctaacgctcccccgatcagacaacaaagcagtgtaggagcggccagaaagaattgtgtgatgtcgccctggaaacggacgatcccccaggctataccggcagaaccgatacaccatccctggtcgagccatatctttccttccggattcaatatggctccgttgtaatggttcatgtaccacatgatcccgatgataagtgtagccgccagccatcctcccatgagaccgtaggttttccaaagctccggccagatgccgaaagcaaaacctccgcatatggccgatccggcaaatgtagataagtaatgtttcatgatattagggttaatctgttagttgagttgcaattttgctagtgtaaaaggcttgtcgtgtccggtatttactttgtcggggcctgttacgatatcgaagcaggaaacgattacctggccgttccatacgatcggttctcccggttggtcgagcccgccgtcgcttccgtcgccatccggactctgggcgatacgctgaatgcgaccgttcttatcgatacgggcaactgcattttccgagaaatcggctacccagatatttccgtcatcgtcgatacacattccatcggtggtacgtagctgtgagggatcctgcgcccagatctcattgccggtaacgctgccgttggcatccattgttatccggtggatcgtaccgtcaccgaagttgccgacatataaatttccttccttatcgaaaacaataccgtccagtccgtactgtacatccttgttcttggtgatgacggtggtgatcaggtttttatcagctctcgtattggttacttttatgttcttgtcattcttgtcaaaacaatatataccgctgaccagtgatcccgacgggtcctgaatggaagagagggaactttgtgtgacatatagctttccatcgcgaaaacgaaccccattgggatgctccattcctgaagcaaccacaatggtttcgtctaacctgccatctttcagctttaaacacaacaatcttcctttgttttgggctttgggggcaccactccatccctggttatcacagataaataaattaccctcgtcgtcgaatgtgattcccatcggagcggcccagcccgtttccggtaataccggtacatctaaccatttatcaatcttcccatctttcgtgatacgcatcaggcaagccggcttagacaaatcggcgaagttcggacaagccaggatcagatcaccgttcggagcaatcgccataccgtcgggggtcgggcaattgtccggtaattccataaatagttcacttttctgcatggcaggtgcatcggtcaaagaaggagccgccgccggggctcccttatacatttgtttttcaagcatcttcataaacaaaccgcctacaaccgaacgggcacggaaaccgactgaatttgcgttggtcgtctcataccagtcgcttaacggcatgcgggtatttgtttcgtttgcatatttgtaaaccggtgataccagttgggtgaaatcgttcatattgtctgtcaggcaagctgtccagaggatccagtctgctttcgtataggtcttacggctgtcgagcggcagaccgtaggtattctgttgggtcaggtagtaagccatttcttttccggcaatttcctgtgggaagatacccattccgaataatttatcccataccaggttatatttctggctccaggtggccggttggtcgaaggtcaggcgatagtgatcaccggcatttgccatggcagcccatttcattgccatctctttagcggcggaaatatatttttcggcagtaaccttatcgcccagcatatcggccagtttaccgtatccggctattcccatgatcgctttgatggaaaggtttgcattgtgtgcgaaatggccggcgaagtcgtccgtacaaagctggttctcaggatcgaggccttctttaagcagatagttcgcccaggttgtcaatgtctcccagtgtttcctggcaaattcggcatttccttcacgaagggcgatagcggttgtcaggatcagcatgttgccgctttcttccaccggcatgtcgccaccgtaagtctggccgttagccaatggataagtacctacatcgtgggctgcaaacggtttattccacctgccgctttcactgtaatagaaaataggtgtcatcattcctttcagtaattcaggattgtatatcaggtacaaaggtgacgaaggataggtaatatcgaccgtaccgatagagccgttgctgaagttctctttggaaaggaacaacagattgccgtctttgtcttccaccagtttatgtgcagcaatggattgacggtaggatattgcacaaagttcggcgtattccttaccgccggctttctctgcgtcgttcatcatctgtgtatcgaactgacggcaacgtttcatgatcgaagcataatcgttgtttgcttcttcaaatgcctgctcgatatttttctggccgttgtgtttccaataggccatgcggttgtcgttgaaatattggatagcatacaggtcgtcatacccgatcatcaggtaattgctgacgggagcggatacggctcccaggtcgtggcagtaggccaatacgctcatatcattttgcatgtcggatgaaagtccttctgctgttgtgttgacaggcagttttccgttagcggcaaagtcttgtttggttgtatggtactgtcccattgtcatggttgtattggcatctgtaccggctgccaggtagaaatatccccagtcgatacgtacatcatcccctttacggcccagtacaggctgttcgattgttcctgttttcagataggtgatattatttttctcatcccggtcgaaagataccgactggttatccgtgttaacggccaattggggagtggcctccatataaatttgtacgtcatgctgctggccatccaacgatttagcctggtaagagatataattgaccggacgtgtcatcaagtccagatcatccattaatagaggggaagtgaaaataacgtccagttcgaccggtccgcattcgaaggtatagaaagtctgggtaggcagtacgttgaccgacttctggatggcagcttcattgaagaatgttttgttttcttctttggtgaacagaccgaagtctacgtatcctcctccggttttgttatggcaatgagcggcaattacatttttgccgggtttcaatgttgcctttacttcggcgggaagttcggataatacattgtttttccatacatagccggtagagattacttgtatgccgttaatatataattcaaagatatcatcgtgagaatattcgagatatacggattgtgcagtgtaatcatccgagagatcgaatgttcttcttacccagatgtccttgctgttccagcgggtggacaggtcgggcatatcaggagtaccgaaagcggcttgtcctttggtccatgcagcatcgttgaagtccggttttacccagttggctgccggtaccttttccgtataggcggcttcccatttctctttggccgctgtgggaataattactttcagaggaaggtcttctactcccataaaacggaaagattgaccgtctacgcggacaacaccgaataacggagcttttttacctgtccaatgacgggttgcatcctcattcagtttatcggtaaacgaccagatgctggtatatggatcgatcgttaccagaggaaaggaaggtgcacgaagtgcattttgtttttcgggttcaaaatagtttgaaggtccgctgcaagctgagagcagccacgaaaacaagatacataataaagatacatttctcatgatatatagcatttttcatttattgtccttaccgttgacaggagcgatcttaataatgtgattcagaaaagggctgtatcccttaaatgagtgcatcattttaactatttttttgtaggcaaaggaacataaattcatattgaccgggttacagttatcggtcaaaagctttcaaatttcaatcagagaagctgtaaatctgttatttatttgtttttataacctctggtcgcaggatgtgtttcaacatccctcttactaccagatgatggaaaggagctatcgcatagaagtaggcatatcccagccagtaatgaaaacgtacgacggtgatacatctgatcttttttcggtttccttcaaattcttcgaggtgaatggatagataagcacagaggtgtttgtcgtccaactgcataatggtttcgtttggagatttgtcggtgacgttggctaaaggggttttttctcctgtccggatacatctttcaatgtccggcttttccttttctccggcttggaggccgaatggttttaccaataaattacgcagtttgaatagtttgttaatccaagccggcatatctgtccagagtgagatcagaatatcatccgcagtgatctttttcttcgtggttatttcacattcaaatgcatccgagtagcttgccgggagatatttgtttatcaggctgtcggtaggaatagtggaatttcttactttcatggtgtctcatttttgttgaaaccggaacaaatatagtttatttctggaatatctccgggtatttgcgaatgaaataagtcggtgtacaactccatgcatgacaatagctattaataggaaagaaattgtatggagataagtattcgttttgaggatcatacacttcccagaaggtatcggctcctttatggatcatatccccccaataggttgcgacttctttttgggcatcttccgccaatccgctttttatcaaggcttctatataatagtggaataaataaggtgcccccgggatacatacattctcagttgttttcaaggctcttaatgcccgttgagcctccttttgtgtgggtacttctcctaatatcatccagatttgagatgcatacgaaacctgatcgttcagtaaccctgcgaacagacccgttttaggattgtagaaatgtttgcgggctgcctttttcatcttccggataagggcgggtagttgggctacttcattttctttgttcagtaactgtgccagttcgtaagtttctttgaaggcaaagattgtgacaccatgaaaggccacttcccggtgtagtccgtctttccagtcgaagaatatccaccattcacgggaagcctgttcgtaattcatggttccgtcgtcctgtagataagcataggccgattcgagttgttttttgacgacaggccagaggtcttcggctgtttcacggtctccggtttccagtaaatagtctttgagggtaacgccgaacaggaaggagtaatcatataaatgttgtttggcttgcggtttgggtaccggcgcttcaaagacggtggcgttcagttttccgttaggttcgctaagcgcggccaacagataaaggcagcgtttggtcaggttatattgtttgaaagaatagttattggctaaggcttcgaggtaaaggtctcccagccagaggcgctggtctcttttggggccatcttcataaacggtctgcatacattctttaagggtgtttaaacttacatggtctatatctttgaaaatctgtggcgtggtggataacagttcttccggatggttgacagcagaagtcacggcattacacttcatatccgagatgcagaaatcgtaaccgggaggtgttgctatcagttcaatctttacatatctgaaagaaaggcggcgcggaatggtggtggtcgcaggcattgtcattacggtaaccgtttcgtcttgcaaccaggcccggctgagccctcctttgtaaggatcgaagggtgtgacaagttcggccggaacttctccgaaggtcagtttaaagcgggccggcgcatcggagtctgcctttagcagatccgtactgaagctgaaactgccagtcatatgttcgccaaaatcgacgatgacagtctttttgtctttaaaagaactattgtataagacctccataggaccttcctgtaccgctttgtatccctggaatccctctttgtcttctattatattgactaatccggtcggtttcttttctgttacagttaaccggggtttattttgttcggctttttgcaaccaggaactgcgttgggttgcatagaagtcttgcccgtaggccgtgataaaacagcagatgaaggtataatataaaaagagttttgtcagggttgtcttcatattccagtcgatttaagcaatatataagaagcctttaaagcataaattgggagtaaaagtagtctttatcaagggaatggatgttgcataaatgatatttaatgttacaaaaatgacacgatgttcaatgtttgcttatttttttatttttagagtatgtgctggtttgtattataaagtttttatctacatttacgatgttaactttttgctaatcaataattcatagatatgactctttcaagaagaacttttattaaatcgagtgtgatgtctgctcttagcttaccttttattcagggatgccgctttgttgatagtgataatgatgaaaatgacagactcttcatgttgtttcagaacccgcctgtcacttcaaaaccctttgttcgttggtggtggaacggagataaagtgaccgcaaaggaaattctgcgtgagcttgatgtgatgaaagctgccggtatcggaggtgtcgaaattaatccgatccgtttccccggaggtgatgatttagggattccttctttggagtggctgagtcctgaatggatcgagatggtaaaaacagctttgaaaggagcagaagaacgggggatgatttgcgatattatcgttggttcgggatggcctttcggtggcgagttcctgcaaccggaggagcaaacccaattgatgacacagacggcaatgaaagttagtgggccggcaaaaatagagttgaaagcggcggacttattgaaagatgcttccccgcaagtcgcttccaaatatgaaggttcaaccagtgagttatattctttctgcctggctccggtggagatgtcaacctttgctcccgcacaagacattcctttcgataaaggagcggaggtgatcgcgatcgatataccggaaggcgaatatatactgtatgtattggtgaaagtgaccggtttccaagccgtgatcaatggggcacccggtgctgccgggcctgtattgaatcattataatcaggcggctgtggagaagttcctgaacaggatgtcggataatctgtttccggccatcagcggcctgaaaggttttcgggccatgttctgcgacagtatggagttggaaggggccaactggtgtcatgattttcttgaagagtttcgttcacgccggggatatgatgtggaaccttatctgccttttatcctttataaagtcggtcatatgggacatgccatcgaaggggcggttgcgactatcctgaccagtcaggcgaaagaggaggttgaccgggtcagatatgatttctttgtcacttgtatggatatcgtccgagatcgtttcctgaaaccatatatgcaatggtgtaataaatataatttcaaatcgcgggtacagacttatggccgcgagtttcatccgctggaagcctctatggaggtggatatccccgaatgcgaaacctggttctggaatgcggacagttgtgaaaaggatgcattcataaagtctcctaccgatacgaacgtaaataagtttgtggcatcggctgcccattactctggaaagaggctggtcagttgtgaagagataaccaataccaataatgtatttaatgcaacgttggaaaagataaagatgacgggtgaccagagtaatctttccggtgtaacccattcgatactgcatggtttcaattatactccgctggaagctccgttccccggatggatcatgtacggggcctttttgaatgagcggaatacctggtggccttattttaatttgtgggctgcctacaaatcccgcgtttcgaccgtgctccaggagtctgatttctttgcagatattgcggtgatgcacccgttggccgatatgtggacgatacacgggccacaacgtgatccgtttcccggactgcattatccggcctatcaatataaagtatgggaagcgatccaccgtaacgggaatagttgcgattatataagtgaagggatcatccaaaagagtagttttaagaaaggctatttgattttcaataaacggaagtatcatacattgatgttgctggaagtcgagtcgatgatgcctgcaacggcagaagccttgtttgaatttgtaaaagcggggggcaaactgatctttgtaggaaaagaaccttataaatctcccggatacaaagatcaccaggtcaatgacgaaaaggtgaaacagacgatcggccgcatccggcagtcttatccgtccctggtgtttaacgtggaggctccggttgaaatggtaccctggtttcgtcaggtacaacagcaatgtaacattgtcccttatatgaagattgatgttccgaacccttatgtcagccagatacgccaccaaacggaggataaggatatttactttataacgaattgtaacccggaagaagagatccggatacaggctaactttgccgataacggtaaaactccctggctttggaatgcggagacgggcgaacgtactccttatcctacctcttccgctcctggtttacagattgtcttgggaccggctgcttcccaactgattgtttttgaaaaaaagaaagcggataaggtcactattccggctctaccggtaaaaagcctgacccctcttagtatcaacagatggaatgtgcgaatggaacatataaacggggatacgaaaaaactggagatcgagacattggttgattggtcgactgatccggtgacccgtgactttgcaggtgtattgtattatgagaagactatcgagaatgctgccggcttttattatctggatctgggaaaggtctacggtgtttcggaagtaattttgaatggagagagtctgggatgtaaatggtacggtaaccgtgtttatcagttgccggaacatctggcacaggctccggtgaaaatgttacagataaagattacgactacagtaggtaattatctgaaatcgacaccggataataaaataggccaggcatggacacattatcagaaatggttgccgacaggaatgataggacccgttaaattcgtgtgattatgaaaagaacaatactgcttatttgttttctgtccggttgggtctttcttgcgggggctgaacctttacgattgaaaagactgacttgcgaatatatagaaaatccgttgggggtagatgcttttaacccggtacttggctggcaactggagtcgtcggcccgtaatcaggtgcaatcagcttatgagatacaagtagctttaacagaagacgatcttaagaatgggaaagggctggtttggaaaagtggaaaagtcggtagccgtcagaatgtaaacattgtttattccggtaagagattaaaacctttcactcgttattactggcgtgttcgtacttataatcaggatggagcggtatccgattggagtcaacccgctttttgggaaacatccatgttgtctccggcagactggaaagcccaatggattaccgacggttcgaaagcaccggaaagagaagaagacttttataaagatgatccggctcccttgttccgaaagatattccgccctgctaaaacagtaaaagaagctcgtttatacattgccggtatcggatattatgaagccagtttgaacgggaaacgtatcggcgatcatatccttgatccgggttggaccaactatggaaaacagatattatatagtacctacgatattacctctttgatcggttccggagaaaatgccataggggtcatgcttggcaacggatattataatccgctgcctatgcgtgtcttcaaaccattgagagaatacctgactatcggacgtccctgtttaaaggctcagcttcgtatacaatatacagatggctcgggagaaactatctgtacggatgaaagttggaaaacggcacctggtccggtaatgcgtaacaatgtctatcttggagaacattatgatgcccgtaacgaaatactcggttgggatacctgtccctttgacgatagccattggaaacaggctgtgcaggtcgtgaatgctcctaccggacaactgacagcccagatgcagccacctatccgggagatagagattattaaaccggtgagaatgacggaaacccgccccggagaattcattttcgatatggggcagaattttgcaggggtagcacgcctcaaggtcagaggggagaagggtacgacgataaagattcgttacggtgaagatatttattcggacggaagcctgaatgtgatgacttcggttgccggacagcaaaagaaagtatgggatgccgattgggagacccacggacaaccgcagactgcctggcaggaggatacctataccttgaaaggagagggagaagaaatctggtcgccccgttttacgttccacggtttccggtatatcgagataaccggctggccggggcgtccttccttgtcggatgtggaggggatccgtttgagtgccgatttgcaaaagaacggcttttttgaatgttctaatccgatgttgaaccgtttgaataaagtcttggattataccttccatagcaacctgttcagtgttcagtccgactgtccggctcgtgagaaattcggttatggtggcgatattgtcggcacggcacgtactttctgttggttctacgatatggaaaatttctatcggaaggccctgcatgattttgccaacgaccagcgtcccgagggaggaatgacggagactgccccttataacggaatagcagatatggggttgggcgatgactccggaccgatcggttggcaactggcatttgcttttatgcagaagcaattatatgaatattatggtgatctgcgaactataaaagcctattatccgactttacgcaggcaagtggagtttctccgttcaaaagcaaaagataacctgatcgatacgtgtatcaatgatcatgaaagtttggaagaacgtgtacccgctttgtttgctactgcccattattaccatcatgtaatcttgttggctgagtttgctctactgactggccagtcgaaagatacacaagtatattcccggttggcaacggatgtaaagaatgcatttattaaagagtttctgaaacggggaaccggtcaagtggcaaatgctacccaggcagcccaagcctttgctttgttctatgatctcgtaccggaaagtgagaaggaagccgtttttacggtattcctgcaggcaatggaaaaatgggacggacatattgcttccgggattttcggtgttccaattattttggaagtactgcgtctgaataacaggaatgatatcgcttatgaaatggttacgaaaaagacttttcccggctgggggtatatgcttgagtccggagctactactttatgggaaacctggaaatattccgataatgtatattctcaaaaccatccgatgttcggtagtgtgggagagtggttttatcagtcattgggaggaataaatcaagccgctcccggtttcagtaagatacaaatcaaaccgcaacctgcgggtgatctggcatgggtaaacagttcctaccaatccgtaaacggaccgatagtaagcaactggaggaaggggaataaaacgtttgaacttcaggtcacgattccggtcaatacaacggcgcaaatctggctaccttctttagacggagcagaaattacggagagcggttctttattgaatgctgtaccggatataaaaataatcggctatatggatggttttacctgtctcgaggtcggttcgggtttgtataagttcactgtcaaagataagtagtataaaattgtgctgatcatcagaaatacggataagcttttcattatcggacatactgttcattatcggacacctgttgctttgcctacttggcagtaaatcagatggatatctttttggcatagcttttgcctaggggtggctaaacatatattacaatgaaaaagatctatatagccattacttctttattcttgatgagctttggtttacaggccggggagcaggaaaatatagtaagactgactctgaaagaggctattaacctggcccaactacagtcggtggatgcggctgttgcccttaacgaactgaagacatcctactgggaataccgtacacatgtagcagaccagttgcctgaggttaatttcaaagggacgatacctagttacagcaagcaatattcccgttaccaacagtcggacggaacctatgcttttgtgcaggataacaacctgtcgatgaacggtgcgatctccgtcgaccagaatatagcgttgaccggtggtaaaatatcattgaattcttcccttaatttctcccgccagttgggggatggagctttcaatgaatatatgagtataccgatcggcttgaccctgacgcaaccgatctttggagtgaacgaccagaaatggaaccgccggattgaacctgtccgttaccaggaggcaaaggcggcctatatcgaaagtgtggaaagtgtaacgatctctacaatcgcttatttcttcaatctgttgctagcgaaagagaatctggtaacctctatccagaacctgaataatgcgaacaaactctatgatattgcgatcgccaaacgaaagatcggacatatatcggaaagcgaactgatgcaattgaaattgtcggctttgcaggcaaaaggtaaattgacggaggcacaatccaatctgaatgccaagatgttccagttgcgctctttccttggtttgagcgaggacgatatgatagagccggtcgttcccgaatccgttcccgatatgcgtctgatatatcaggatgtactggggaaagctttggaaaacaactcgtttgccaaacgtattctgcgcgaacaactggaagccgattatgccgtggcgacagcgaaaggaaaacgtcgcgatatcaatctgtttgcatccgtaggatataccggaaaagacagtgacttcagaggggcttataatccgctgcgggacaatcaggtagtcgaggttggctttagtatccctttattggattgggggaagcggaaaggtaaagtaaaggttgccgagtccaatcgtgaagtcgtgctctccaggaaccgacaggaccagatgaccttcaatcagaatattttcctgctagtagaaaactttaacaaccaggccgcccagctcgaaattgcagccgaggccgacgagattgcccagaagcgttatcagacatctatcgaaacatttatgatcggaaagatcaatattctcgacctgaacgacgcccaacaatcgaaagacgatgccaagcaaaagcatattcaggagttgtatgggttttggagttatttctataatgttcgtagtgtgacgctctacgatttccagaacgatcgtaatctggatgccgatttcgaggaaatagtaagaagataattcgtatctttacaaacctaaaaagaaacctatatgatattaattgttgatgacgacgctgctgttcgttcttcgcttacctttttattgaaacgggcaggctttgaaccggaagccgtcccggggcctgaagaggcgttggcaattgtgcgccgggaagcaccgcagttgatcctgatggatatgaactttaccttgactacgacgggagaagaaggaattcaattattgaaacaggtaaaaatatttcaacccgatgtgccggtcatcctgatgactgcctggggttccatctcgctggctgtgcagggaatgcaggccggcgctttcgattttataaccaagccctggaataatctggtcctgcttaagtcgatccgtacggctctcgaactgaatgagcagaagaagatgcagactgctccgctgaaccgcaacgatgcggataataaattccattttgcaaagatcatcgggcagagtaatgcgctgatggaagtgctgggtaccgtttctcgtattgctccgacaaatgcctcggtactgattaccggtgaaagcgggacagggaaggaattgatcgcagaagcaatccatgccaacagtccacgaatgaaagaagcttttgtgaaggtaaacctgggtggattatcgcaaagcctttttgaaagtgaaatgttcggacataagaagggagcttttacggatgcctatatcgaccgtaccggacgttttgaaatggcaaacaagggtacgatctttctggatgagattggcgacctggagttgtcgtgtcaggtgaagctgttgcgtgtattacaggatcagacctttgaggtgctgggtgacagccgcccccgtaaggtggatattcgtgtggtcagtgcaacaaactgtaacctgccggaaatggtagcggcccgtaccttccgcgaagatttgttctaccgtattaacctgatcacgattcatctgcctgccctgcgggagcggaaagacgatatacctctgctggcccgctattttgccgataagcaatcggaggtgaacggcttacctcatgtggacttttcagccgatgcaaaagtatttctgcaacgtcttccttatcccggaaatatacgcgaattgaagaatctggtggaaagaacaatgctggtatccggcaaatccttattagacgtagccgattttgaaagtcagtgccttaatatgggaaatccccaacctgtacccaaaggtggtgctgccagtttcgaagggatgacactggatgaaatagaacggcaaacgatcctgcaggcacttgaaacgcataacggtaacctgtcgcatgtagcatcggcattgggtatcagccgggcagctttataccgtcgtttagagaaatatgatattcctaccgataaataaggtatacggatgagagtaaaagggttgttctggattttaaccgggttgttgttgactgtgttgggagtgatgacctggcatgtattctataatttctcgtctgccatgtttttcatggtggaagggctggtacttgttacaatcttttatctgatcctgttttatcgtcgtattatcaagccgttgaatattattggaaatggtatggaactattgaaggaacaggattttagttcacgcctgagccgggtagggcagaaggaggccgaccgtattgtcgacatcttcaataagatgatggagcagcttaaaaacgaacgcctgcatctgagagagcagaaccatttcctcgacttgttgatcaatgcttctcctatgggagtgatcatgttgaacctggacaatgagatcatatcgcttaacccggccgcacataaaatgctcggacaacctacctctgttgttttcgaagggaaatctctgacagatatagattcccctttagctatcgaattggcaaatatacctttatatgagtcacagacagtgcgactgaatgatgccaatatttataaatgtacgcattcctctttcgttgaccgtgggttccatcattcattctatttagtggaaggtttgacacaggaagtattcaaggcagaaaagaaagcgtatgaaaaggtgatccgtatgattgcccatgaggtgaataatacgactgccggtatcacttctacattggatacgcttgaatcgacctttagcgaactggaaaatacggaagatatatgcgaagtactgcgtgtttccatcgaacgttgttacagcatgagccatttcatcacgaatttcgcagatgtggtacgtataccggaacctcagacggtttcttgtgaactgaatgcagtcgttacttcctgtaagcggtttatggaaacgatctgccggaatcgtaatatccggattgtcatggagcttgatgaagtttctcctgttgtaaagctcgacagttctctttttgaacaagtattagtcaatatcataaagaatgctgccgaatctatcgatcacgacggccatatttacatacgtacttcacataatccggtctgcctggagatagcggataccggcaaaggtattgataaagagacagaaaccaaactgttcagccccttcttctctaccaaaccgaacggacagggcatcggcctgatctttatacgtgaggttttacagaaacaaaactgttctttctccctgcgtacttatgccgatggcctgactcgcttccgtatcctttttgaatgagtttatttactcgatctgtaattgccggcttattccgcaaaggaatagacagtcgatatattcacaatgttcggatggaggggtaatgtccaaacgacctgattgtccggattgatttcgaccagtaacggttgtgatttatttttactgtgaccgttccagttgcttattagcgtattgctgtttttataccgtaccagttctgccacgaagagaagcgttatatcctctacatcgtcatcgcctacatttctaacgatctgctttcgggccggatcgatttccacgaagttatgcgcatcgccgcaggatacgagccagtttccattgtcgagtatctggatggcaaaagggttacctccgcaatgtacccggttgacgatctctttgtctttgttcatttcaattacttccccttttcccattaatgggatcagataggtgttttgcggggttttcacgatctgccggaactggtcgtgtacgccggttatactggtgtcgaatgatagttcatcgatcagtttcccattcgtatcgagttcgacgatacgggaaggagtaccgcagatagccagcatatagttgccggaggggagacaggtggcagtgaaaagctcttcgcccttttgggctttgaaatcccagacagtttgttgatcgcgggtaatcagccgggcaccggaggtatatgcatagaggatatgaccatctgctgtcatttctacatcgttacaatcttctcccgggtttagcgggtggctccattcgatcgctccggtcgctttgtcgaggatcgctacctgcttccagccgcagccggaaacaagtaacttctctttggtattgttacatgagcaataagtgctaataattgctatgaaaaacaagtatctgaaatagcgctttatcattcttctgtcattactacacggaatcctacattatatactttctggtattcacggtaaggcaggcggaaagaagaagttgcccggtaaggacggtcgtaccaggaaccgccgcgtgcaacacgcttaccattttcagataccagctcgttgcggccgtcgttttcattgtacggataaggctggtaactggataaggtccattcccaaacatttccgtgcatatcgaacagatcccacgggttgcggatatagcggccgacaggttcggagataaatccaccgtcattataggtggtatcgcgtggaatccaatcgtcgtatttattgggattttcaattaccatagcactttcgtagaacttataggcggtgcaggcggcaaactctttcaatttaatatctcccaggttggcataggtcgagaagtcggcagacatattcccgtaccagaacggcgtatcgcttccggcgcggcaagcccattcccattgcgcttcggtagggagtgagaacttcataccagttttttccgataaccatttgcagtaatccatcgcctcctgccaggagattcgtaccgccggttggtcggggtggttcatcgaatatcccctacgtccgaactgatatccgtggcggtgttcgtcgcggctgtcgtgttccggatcgtatgccctgaactgtgcgttggtgatttcgaaacgtcccatccagaacgctttgtctacctgtacgatcgtttgcggcaactcgtccggatggcgatcgctacccatgataaaggaaccagccggtatttttaccagttccagggttatgccgttacccagcgggatactcttctggaaattacccaaagccagttgtttccattgggtgtctccccattgggaataagctttttgggtaggatcgtataccggccatttgtcaagtacggtatcaccaagaggcttttgttctttttcgaatctgaccggctcgatgttttgagggatctccggcaaccattcggccgtcgatttaggggcaccgaacatttcacgatatagttcccgtagttcgttacttttctgcgtatccgggaagttcggaatatccgaacgacgtccgtggaaaggtgcgttgaagtcgatccagcaggccagtttctctatcgactctttatccagttgtacattataatgtcctttctgaaggatttgcatcaactccgtctggtcggcatgtacatccatcggaaccagcatgtgcatgtcgctttcgatacccggccggcgtacatatcggtgcaggttggcatacgacagggtgaaatgacctccgtaatctgatccggcccgaccactgatctgtgaagtccagtccgtgatccatcgatcgcctttcaggtagggctttcccggtttatcctgattgtggcaggagatacaatatttatccaataccggttgtacctcatggcgatagctgaaaccacgttccttaccgtaccattctttgatcggttgcgggcttttctttgaagccgtggtcattttgggaacaggtatggtattcttgtcttcatggcagccgatgcaggaaagcgtttcgcccggcattccggtaaaccagctacgcattacctgaagagcttttccttcttcgtcgagcggttgaataaagatcggcgtattggccggaacggtgaacatggcagaaccgtcctcttctacatctacttcgccgagaatacgtttaatatcccaagggccatccataccgatcgtacctaacaaacctccctggttcagcggactgaaactaaaggaaccgacgcgaagtttcttcactgccccgcggggaatgcctttcaggccatcgccatgatagacatcctgcatgaagacggttgtggtggtagatgccaggtctatgcggtcggggatgatagccggggcttttctggcttccatcagtaccggatcgagataggcgatgttttcttcttcggctatcagggtacggttgtcgtagatatctaccagatagataccccacaggctttcggggctatccttcatagataccagataataggtgtcgttcagggggtaaggttgcaggaactgaggccatacgccatccggcaagcggtcgcgtaccagtggttccacttttcgtccggcatgggggatctcggcgattactccgtctgcttcgtgtcttcctttacgggtatcgatcacgagcagacgtccgctgcgggatacgctgtggtgtccggtcgctactccgacaatggctgacggacgtccggggatagggcgggcactaaagaatgacgtaggaaaataggagttcgaaccatagaaggccgattgcgaagtgccgtccgggttcatggtaaacatgacgcgtgagttggaatggggcaggtctgcatattcccaacgttgatagagcagcataccgttttccatcataaccgggtcccaattactgtcctggtcgtaggtcaactgacgggtcagttgtgttttggggtcgtaaagatacaggccgcacattttgtttcctccgtttgtacagggaagtccgaggaatgtccctgtggagcagaagatataccgtccgtcgggagtgtagcaaccgtcgaaactgtcgaaatctttatagctatcgggtgtcaattgccgtgtctttccggttttcatatccagttcgaacagatgccagcggtcggaggttccgatggaggaatacattagtcggtttccatcgaagtgaggttccggatcagtgatgatcatgccctgttccggtttatagatagtggtttgttttattttgccgggggtaatattcagggatacgaattcgttcgtccatcctgttttagggtttcctatctcggagttattctggaagttggaaggagcgatacctaatccgccactcatggctttacgggcattatcgcctaatgttctccggatggcaacgacctgtttgccggccagtagcgggttggccaataaagcggcatccagttgttgcagtagcttttgggcttgtttctccgctttcggatctttggctttcaaacctttgataagtgtttccttatctgccttcagttcttcgagagccttttcgaaatctttatccggacgataactatccggatatttcttcttcagattatctgttgccaatttgtatttttccggtgaataataggtaagccggttaatcaggctttgccaggagtcctgtgcggaaagtaagaacggacaacatagtccggccaaaataaacagagctgtaatgatccgtttcatagtgtgttagtattatgttataagatgaagtttagtagttacaaaaataaagcatatcttttttttaactttgacaaaataagatgaatactttgcataatccgatattgtgatttgaatataattcctatatttgcgacggttaactaataaacatctgatatgcttgtctcttattctccgtatgacctgtcgctgcctttgctttatgccgatcattcccgggtggaaacctggtggaattatcaggatgtcatcagccctttttaccggctttatttgataaccaaaggaaaaggtaaagtttatatcaatcagaaaggatatgaactgttacccggccaactgttcctgatacctaagtttgctttccatagttatgaatgcgatgattttatggagcattattatatctgtttctttgacgaaacgaagggagggaagggcatcagtaatccgatgaagatgaatttgcaggtggaagctactccaatggattattctttgatggagcgttttctggctctaaatccttataaatcgttaccgacgtcagatcctaaacattatgataatgaccggaatatttataccaaggaggaggagatatctgtttcgacattttccaacctggtagaaagtagcggtattctgctgcaacttttttcccgttttataacagaagagtgtctgcttttcccggaggcgaacagtttgtatgagaaactggatgtggcgatacaatatataaatacacatctggaccgacgtatttctgtttcgatgctggctgatctgatgtgtattacttccgaccacttctctaaggtattcaaacggataataggtatgcctccttgtgagtatattcagatgaaacggattgaacgggcgcagactctattgcttacttctcatatgtctatcattgaaatagcggaaaaagtagggatcagtaacctctcccagttttcccgcctgttttcgaagatggtccgttgttccccgagagaataccgcttaagacaattcaatgcactgaaatccgagaatcatagatgacctgacgtggcatttagtcaaacggctttagcactatagtgacgcaaccatcagcactatagtgccagccatagtaggactatagtgctggcactttgagatgcaacagcactatgacttactggcttttggcctgataatccgtcttgtttttatttgttgagtctgattccttccggtgtccctttggtgatgtaacgaataattacttccggtgcgtcttcgctggtctgttcgcaagaaaaagcgacagccgatgaaccggcaggaagcagggctttaccttgaggttgcacttcgctgatcacattgtaattcttatcggtcactaccgctttaccatcaaaagtataaagcaggtactggcggtcggagatctcgcaagggaactttattactcctttaggggttgtgaatgacggatctttgatcgtgccgtctccatctactttcaaacggattgcatacatactttcgtaaggactttcccatgaccagtctgctccgcctggttgtcccggttgcatttctgccaggttacaacgataatgtttggagatatggagcggataaaggttgtagttttcttcacttactttttccagatgccattcagtcagcggatctctcagtagagttttttgttcttcagtgaaagcttctgcctcgcgtagcttgtcccagtttttgatagtttccagtaatttatcgatctgtccgtgacggcgtaatgtgttactgttgatcgtcatggcatagccggcatcaaaaccggctgattcggataatgcccactccaggtcctccagggaagaacattcgaagttacggtctgccaggcggatcaggaaccatcccaacatacgcggaaaaagattacgtttgaagaatgcctggttcttgatacggttctctacctgccctgtacgcatcgcttctccccaaggctcgccccagttcatgcgggtatggatatgccataagttatggctgaggcggctggcgtcgttcaatacgttatgattcagttgattgtaccagcgatagacaaagcggttgtttgcatattcgtcttgtccggtgtaagagcatccttccagaccgtcgaaagagatctggcaaagtcctgttttattcataatctcagccaagcggtcggagaatttatcttgcaggaccaggtcggggaacagggttttatacggataatcccataatttgtaaagcggggtcttttgtgaatgagcagtagctgtcgtaccgtatgcgcctcttttacagtttttcagcagaagagtttctcctttatcctccgtgtttccgtaagtaatcagctcctggtcgatctgcatggcgttcagtgtcatgggtctatcgaacaggctagactttttgattgtgatttctgtctggtctttgtccaggtcggcagtgagtgataaaacgccttgcttcagcaggtgttcggtagggacaggagtgacatacgcatcgttggttgtcataaagttgctgagcgtatgtacgccgacggcaatgccttcagcctttgccttgtctaccattttcctgacaccctcatcaccgcttttcgtgaatttaggatcccagttgaaatgtccccagtctaggaacggaccgctatggtatacatatttgaatccggcaatcttagctttatcgaggatcatgtcaaaattattttccgagaagtcggagatcagataagacttcatggcagcacgggcggttttgccccattcgccgtcgaacaaaggatgtggcaaaccttgctccagttcgatttctccgatacgggcaagagcttctgtatttttacttccgaagaaagctattttagcccctttgatcagaccgtctgctccttcgaccgggagaaccagtgagttattcagtccttgtacctgacggtattcctgtttatttcttctgcgggcggagaaatggaatactgtaccatcggagatatcggcagccgccagtttgtaatcagggatgctggcaacggataattcggcagcttttccggtgtaaccataagtttgtgtaaccaactggccgtactcttccggtattcctgcatttgtcttgatgttcagcgcctgtatgccgaaagcaacaccgttgccctgagcgacaccgaccacatcgccgaccatttcattgatattaacggctaatggaccgaatagcaatacttcatatttttccgggatattggctacttccaacgtaatgcagacttcgctttccttatgtttcagggagatagtccccccgtcggacatggtcagtttaagttgattgccactggaagtcaattttgtcggggtcaccagtttgttatctatacaggccgttacgagcgggtactttcctgtgtgtaaaatatcttttccttctatctggatagaagaaaagtagccattgttgtcgatcccgatttgggttgaacgggttttcaggtttacattctgtgcaccggcctgaaagacgaacgcgaatgtaaaaagcaaaacgattctaccgattaaagagaggtgtttcatgtttgtttatttaatatgttaaccttttatttttgatatagggcctttactaatgccgggtctaacgaagcagacggattgaaacggtcggatgccatatattgcaggatactctgtcggaactggcgtgctgccggacgtttatccaggtctttttgaaggtctgcactgcataccatcagttttccgttacctattttgccttccagcaggattcccagtttccggttcgtgaaccagtcatctaccagttgcactatcggacggtaatctgccgggaagtcatccaataccattgcattgcaattgcttaccagatcccaccactgataatcgctgtatccttcggtagggaaggctgccagtgccgggtgtgccggattgcagaggattcccagcgtatggggaggttgcttgttcgtccaggctgtattccagaagatggaagagaaaccgacacggatatctccgcctttttccggcaggatacttccgggagctaacaggagcagcacattttctcctttgtcgaggcgttccatcgtctggttgtcgagtgtagaggttatatagggctgttgctctacggcttcttgtttggcggggtatacccagatattccattggttcttactgtttgtctctttcacttccacgctgacaagcagttgcgatggttcaccgataccggagagggcatattcgatttcacctgccgggatacagttggttaccggaaggtctttcgtgaaacagccttgtgccagtttagtaccggcccggtcgctgatctgccagttgatattggctgcctgtaaaggtttttctccgaaatgggctatttcgaccgggacacttaatgtctcattattcaaccagaccattttggggaaacggataagcggaactgtcttgttacagaatgtgctgtattcatcacctgttacatatcctttttcatcccagaacggatcgagaacgcctacaagcgctgtcccctgccccggaaaatcatgcaagtcgagtaactggaaaccggcaaagcccggagtacgtaatgctgcttctatatcggctttgtaacaaagcgtttgtaaccggccggaagcataaagaaatgcatcggcaaggtcgtccatgtgatgatctttcaatgtttctcggaatatctcgaagtttttagctttcaggatgccggtgtatttatctatttcctttaagttcggatatacacaccattgtccgatctcatggctgacggtcggcatattttttcggatgatatcggcgaagtcataatcggtacggggaggttgtgcgttgattacactgcgcaaaccttctccccatcgctggatacgcggatccatcgggtcccaatagtctgcattgtccacataaggccatccaccggcggtggtatagacatggcgaaggtctttcgatttccagtagtcgatcaaaccggacaggtattcggcttggttcgctccacccggttcgtttccataggccatcaagcagaaagaaggatggttgccgtattctttcaggatgcggtcgctttcttcgcggaaccactggtcggagtaaccaccgtttcctacggttgcccaacctgcacattcgacctgcagatagaatcccatactgtcggcaacggcgaaggctgcttcgggaggacaccaggagtggaaacggacatggttcagaccgtatgctttgcactgattatatatttttgtccagtaagcacgatccatggcgggatatccggtcagcgggaatatacagcattccagagttccccggaggaataccggatggccgtttacttcgaaacgtgtaccgtttgccttgaactcgcggagaccgaaagtacggtattgctcctctttctttccgtcactctctacgacagcacacagtgtgtagaggttcggattgtgctccgaccagagcagggcatcttctcccatagatagagtgacttcctgcttcatcccggcttcggggttgatggtgactttatgaggtttgccaaccacaccgccgtcttttttctctatctgaagaaggagggtggcatcgtttgtttcggttgtgccatccaatgatacggctaccttaatcgttttatcggtgatgttcgggtatatctgtatgtcgtctatataaagggacggtttggctgtcaggctgatcgttccgattacaccgttccagttcgactgtgtatggtcggaaacgctatgtgcattcacgccgacttcaatattgacccggttgtctacgcgaagggtcagcgtatgtttaccgggtgccaactctttgaacgtatagcgatagggagtagacaatgattcgtgtttccccatttcgacaccgtccagaaaaagtgtcgtttcccaatgcgtgcgttccagttcgagttgtaccggattaccactccatgaggcaggtatgtcgatctccttctggtaccaagcgactcctacataatgtttgtccggattcagccagaaaggtactttgatatttcccggctggcggaatttctcatataaaggggaatcataccatgacttgtcgacgatctgtccggtccagggtgtttcaatcccgacctcatcgccgtatccctgctcctgaagcgaaccgggcagatggatcgtgtcggtcaatgaccgggtgtaccattgctctgccagtccacggtcgttccggtcgagggcaaagcgccattcaccttgcagggattgtttattatctgcctgacggcaggctataagggtcaaaaaggagagtaaaatcaagaaactctttttcataagtactttatttgtgtaagttagatatacagttgtctttattttgcaaagaaaagtgtttacgaagagagattaaatagataataatatctaatagatggactatcttacgattggaggggaaggaacaaaaaaaatcccaaaagtaagatgatatacttttgggatcttataaattctggtttgctactattttacagccattctttcataaaactgtccatctcttctgcgtgttcttccaggctttgcagcagtttgaactgagctttagtacggatcaggttatgtttcgggctatggatcttataataagtatcgccgttgatatagtctgtcaggaagcgtacggtctgcatataagtcaatagacgaccgccataaggaagcaggctgatttcaagcggagaaaggaatgccttggctgtttccatataaccacgggtatatgctttgaagatatccatgttcacatttacgttgtccaggttttcatcgtcttctgcaccggtgtttgctcctgtacggataaagtcaccgatatccgacaaaacgaatcccggcataacggtatcgaggtcgatcacacagagcactttgtctgtgtcggcatcgaacatcatgttgttcacctttgtatcgcaatggtttgtacgtttctgaagtttgccttcacgatataaacgttcctggatacacatggcatccgcacgtttttctacttcttcgatcaggtctttcacttcttccagacgtccggcagcattagccttaactgcatcgtggaattgttgcaggcggaattccatattatggaagttaggaattgtttcacccagtgatccttccggcaggtctgacagcatggattggaaatcaccgaaagcttttcctgcttcataagacagttcgggagttacttcttcgtagcttttgctgttcgggatgaacaggcatacacgccagtaactgtcgccgtcgaagtaataaggtttgccctcttttgtcggaaggaaagtcagtactttacggtcgatatcgctttcgcctttggcttccagtttcttacggatatgtgtcgttacagtgttgatattgttctgtaacatatctacatttgtaaagatcagatggttgatacgttgtaatacgtatttgatttcacctttttcgttcgttactttcagcgtatcgttaatgtgtccgtttccgaaaggttcagcggaaactactttttctgccagtgtgaactggtcgagaatgttcagtaattcttcttttgtttttgccatggtattttattcgattaatatagcttttaacaagctacaaatataggaatatttttaatttcccctctttctaattccgaaaatggggagagcataaaaaaaggctgcgaactaaatcgcaaccttttttcatttccttgcaggaaatgattatttcttattacggttaccgtaacggctcatgaacttatcaacacgtccagcagtatccaccagtttagacttaccagtgtagaacgggtgtgaagtgttagagatttcgacctttaccagtgggtattcaacaccgtcgatttcgattgtttcttttgcattaatagttgaacgagtgataaatacatcatcgtttgacatgtccttgaatactacaggacgatagttttcaggatggattccttttttcattgcttctttatctaatttaatttatactcttattagtttggtaaccggtaaattggcttgcaaaggtatggatttgctctaaacaaacaaagaaattctgactattttttccgaaaccttgacttttgtgttattttatatgcttaatagcataatatatttggatagtttttatctttgtacaagattttcaatcattaacgtaataacatatacaacaatggtaaattacaaagacttaggtttggtaaacactaaagaaatgtttgctaaagccatcaaaggcggatatgcaattccggctttcaacttcaataacatggaacagatgcaggctatcatcaaggctgctgttgaaacaaaatctccggttatcctgcaggtatctaaaggtgctcgtcagtatgctaatgcgactctgttgcgttacatggctcagggtgcagttgaatatgcaaaggaattaggttgtgctaatccgcagatcgttcttcacctggatcatggtgatacttttgaaacttgcaagagctgtatcgattcaggtttctcttctgtaatgattgacggttctcacctgccttacgaagaaaacgtagctttgacaaagaaagttgttgactacgctcaccagttcgatgtaacagttgaaggtgaactaggtgtattggctggtgttgaagatgaagtttcttctgaccatcacacatatactgaccctgaagaagtaatcgatttcgctactcgcacaggttgcgattctttggctatctcaatcggtacttctcacggtgcttacaaatttactccggaacagtgccatatcgatccgaagactggcaagatggttccccctccattggcattcgaagtattggacgctgtaatggaaaaacttccgggattccccatcgtacttcacggttcttcttctgttcctgaagaagaagttgaaacaatcaacaaatacggtggtgctttgaaagctgctatcggtattcctgaagaagaattgcgtaaggctgctaagtctgctgtttgcaagatcaacatcgactcagactctcgtctggctatgactgctgcaatccgtaagactttcgctgaaaaaccagctgaattcgatcctcgtaaatatctgggcccggctcgtgataatatggaaaaactgtacaaacacaaaattcttaacgttttgggttctgacaacaaactttaattcaggttacagtgactagtcctaaataaccgttacagttattggacaaaaataaaacattcagaacagttcagcaaggctagccttgctgaactgtttgtttttataacttttaattttaatttgcctctgatggtgcatatactgcggtgttttgtccaaacttaaccgatttgtttcatattcgtgaactactgataatttaaaggacatgctgtaatccttttgtgtacgtctaacgtacttgctttctaacttttccatttcgttactttgttaggtgtaacgatattttaggactagacagggtaaagatacaaaaaagggcagcttttttatggccgccctttccttatttgttatcctgtcaggtattataaaccttgtccgtgacagtttttgtacttcttaccgcttccgcaagggcaaagatcgttacggcctactcgtttttcggcacgaaccggttcttgtttgggttgttgcggggcgcgttcttccggatcattgtttccgctgatatctgtcttttcagtacgataacggctcatgtcctgacgttcttccggaccggcctgtcttacttcgatacgctgacgttcggcggcagcagctgcggcggcagcctgttgttgagccatagcctgtttctgttcttcagtcggttcttcgcgaacagggatctgaccacgcatcaggatagaggctgtcttacggttcatcgtgtcgaccatcatcttgaacaggttgtatgattccagcttgtagatcaacaatggatctttgttttcgtagcttgcattctgaacggaatgacgcagttcgtccatttcgcgcaggtgctctttccatgcttcatctatggtgtgcagaacgattgatttctggaatgctttcgtgatcgctttacattccgtgtcgtaggcctctttcaggttacaagaaacgttgtacatacgttttccgtctgttaccgggatcaggatgttttcgtacatcgcgccctggtgttcataaacctgtttgataaccggattggccacctgggtcatacgttccatacggcgtttgaatgtctgtaaagctgtgtcgaacagtttgtctgccaactgcgtagctttcatgctcttgaattcatcttccgtgaacggactttccatagcgaatgtcttgaacaactccagtttgaaaccttcataatccaggccatctgcatgttgttcggcgatagcattggaagtatcgtaaatcgtgttcaatacatccagaccgatacgttctcccatcagggcgtgacggcggcgggtgtagatcacgttacgttgtgagttcattacatcgtcgtattccagcaaacgtttacggataccgaagttgttttcttctactttcttttgtgcacgttctactgatttgctcaacatgttgtgttccagtacttcaccttccttgaagcccagtttgtccatcagtccggcaatcttgtcggaggcgaacaggcgcatcaggttatcttccagtgatacatagaatacagaagaacccgggtcaccttgacgtcctgcacgaccacgcaactggcggtctacacgacggctctcgtgacgttccgtaccgatgatagccaaaccgcctgcggcttttacttctgccgatagcttgatgtcggtaccacgaccggccatgttggttgcaatggttaccgttccgctctgacctgccagcgatacgatctcagcctcacgctggtgtaactttgcattcaatacgttatgtttgatcttacgcagggtaagcatacggctcagcaattccgagatttcaacggaggtcgtacctaccagtaccggacgtccggcttcaaccaatgcgctgatctcgtcgataactgcagcgtacttttcgcgtttggtcttgtagatacggtcgttcatatcgttacgggagatcgggcggttggtcgggatcaccactacatccagtttatagatgtcccagaattcgcctgcttccgtttcggctgtaccggtcataccagacagcttgtgatacatacggaaatagttctggagagtgatagttgcgaatgtctgtgtggctgcttctacctttactccttccttggcttcgatagcctggtgcaaaccgtctgaataacggcgaccgtccatgatacgtccggtctgctcgtcaacgatcattaccttgttgtccatcactacgtattcatcgtccttttcaaacaatgtgtaggctttcagtaactggttgatcgtatgtacgcgttcgctttttacagagtagttagccagaatctcgtctttcttcgcctgcttttcttcttcagatcccttgaagttttccaacagggaaagttcggaggtgatatcaggtagtacgaagaaagtgctatcgtcggagttacccgtcagcaggtcgatacctttatccgacagttcgatactgttgtttttttcgtcgatcacaaagtacagttcgtcggttgcttcgtgcatgtgacgcatgttttcagacatgaagtattcttcagtcttcaacatctgggcttttacaccctgttcgctcaggaatttgatcaacgctttgttacgcggatatcccttgaatgaacgatataattggatagatccttcttctacttctttcgggtcgctgctggccatcttcttcttggcttcgatcagcaattttgaacacaggtctttctgtgcgtttacaaccacttccacgtttggacggaactgttcgaacaactgttcttcgccacgggggatcggaccggaaatgatcaacggggtacgggcatcatcgatcaatacggagtcgacctcatcgacgatggcgtagttgtgtttgcgttgtaccaggtcgttcgggctgatcgccatattgtcacgcaggtagtcgaaaccgaattcgttgtttgttccgaaggtgatatctgcgttgtaagcggcgcgacgggcatcggagttgggctggtgtttgtcgatacagtctacggaaagtccgtggaacatataaagcggtcccatccattccgagtcacgttttgacaggtagtcgttcacggttactacgtgtacaccgttacgggtcaatgcgttcaggaataccgggagggttgccaccaatgttttaccttcaccggttgccatttctgcgatcttacctttgtgaagaacgacaccaccgaacaactgaacgtcgtagtggaccatgtcccaggtaatttcgttaccaccggctttccagtgattcaggaagattgctttatcgtcttcgatgcgtacgaaatcatatttggttgccaggtcgcggtcgaagtctgttgccgtaacgacaacctcttcattttcagtaaagcgacgggctgtttctttcatgatggagaaaacttccggcagcgattcttccagcacttcttccatcttgtctgtaatagccttttctattttgtctacttcagcccagatagattcacgttcttccagttctttatcgtcgatgcctttacgaagctcttcaacctgagcacgttcggcagctacataatcctgaatacgttgtttgatttcatctgtttttgctctcagttcgtcgttcgagagagctttgattgacggatatacggccttgatcttatccacgtatggagtaatttctttaaggtctcgctgcgacttgttgccgaacagcttcgtcataatttcattaaatcccatgatatatattaatttatttatttcgtaaagtgtttatttgttgacgatcgggtttagtctgtcatttcttggttgtcaactcccaaagaggcagactctgggatgcattcggtggccgtatcctcagcacatgggttaccgtaggggctacctctgtggctttcacttcacggtagatatgttccggtttgagaccgttacccataaataccaatggggtaattactgcgttattacgaattattttaactttttctttcggattgtcgttgttgatgatccagcctggctgcaattcgatgatcagatcgccgcgtttcaggtggtgggttccctgacggaacttggcagtcccttcgttccattcaccggtacgcagggcgttgtcggtggtaacatgctgtacaccgctgaattccataaggaattcggccgccttgtcctgtatggtcggcagatcgagttttgcatcttcaatggctttgcggttcaggtatatttggttgttgtagaatccttttacccagctgctttgctgtccgtacatggccatcaggtacatgttcaacagggctacgcaacgtttcgggtggaactcaccgccattgataagcaaaccgtccggatattcctcttcgcttgtataataaccggaacctgtaaatacgaccagtgtattggcaaggcctatctttttatcgatggcatcgagcaattgctccaggtctttatccagttgatagtaagtatcctgtatttcacgggtatagtccttactcatcgttcccttatagttaccggcatagtaggtaatcgacagcatgtccggacaacttcgtgtaccgaacgcaccatattcaaggaactgcagggctaacctgtttatctctttattaatgaaaggtgttgttttcagcttcggaaaacaatcttgcgtcttttcattaaaggtatatttaaaaggaatttcgtcgagcacgtaagggaaagcattatacttttccaatgggagggccggagtccagatcatcttatccagacgtgccgataacgattcggttccgttattgtaacggtctacataccagggaatacctttataataagtagttgtcgcccattttccgttcaaatcatccatccagaaagcaccgtttgctgcatggccggccgaaaggattgcactttctgcatccggggcgatggagtagacatcacttctgcctttggaggctattttcagttcgtctccgatcgtggagctgaacatctttttaggagagtaattctcgcgggtatagtttcccagataatcggcatcgtaaaggatggagacttctttgtccttatcgaaatcgtagtatttacctccgctgataccgctaaagcaagggttgcttccggtgaatagggtggcaaaagcgctcgcctggtcgatgttggagaactcgaatttgatattgttgtataccagaccttcgttcatcaaccgtttgaaaccacgttcgccgaatgtgttgtaaaaatattctacataatcgcccctcagttgatcgacagtaatgcaaaccaccaacttgggggtacgttgttgtgcctccaggttagtgactaccaggatcgcgataagcgacgttattatttttctcattcgattgtccatatcttcaattgtgcatccgccctctgtatataccgaatcctgaacgtagccaaagggtggcgacaagcggaataaaggctatatttaaatgctgtgggatgaaataccaacccgccaacaatagcgtaagcgccgcaaagttaataaaatgataataatatgcagcctttccgaacttttttactgcaaacaaaataacagcaaccaggtcgaatggttgcaaccatacgatcgaccagttaggccagatgcagggatgagtcgatataaagcagaggaaaaacaacaccgtacctgccactcctgcaaggagaaagaggatacaatccaccaagcggaaatatgtttttttcttccattcgatataggttgtaaacagtaccagcaggaaaataagtatgctgcaaaacataggagtgaaccactctttattcccctgatcgtcgtctgtcaccttttctgcaatgcgtgtggttgattttacgagcattctttcgctcccgtcggggttgacgatcgttgccttttcgaattcgtctttcaaatatacaggcaggaacatcatttcgtgcggagtggctacgcggtctgtcgggcttccgagtgccaggtcgcatccgaaagtaagccatggattgttacgcgtacagtaattaataaggtcgcggaatgtctgcggcttgggaggatcgttatatctgacttctccattcacctgttcttctacgattgcaaccggacgagtggcgcagttatcgaaaaagaaattgtaccggtaaacggcattctccggctgtgcgttgttgatcagcgcattccatattttatcgatctcttctggggtgaggttcagtacctgttcggttacttcgcttccccgcatctgatattctactatataatgtgagaaattgtacgcagccagtttataatccgtttcccctttcgtaaaacgatagatgaagttgggttttgagaagtcgaaaataccatagttgaatacaacatcgagcttatgcaaagtatctttaacccgtatggctgtatgtccatataaagtatatacttcatcattggatggagctgccgtcaatatgctgatctgcgctccatcacttaatctgttttgtgcttttgccgggatcagcaaaaggaacaggaaaagcagaagcaaactttttttcatacgatatttgttttaccgcacaaaggtagagctatttttttaattgacaattggtcacggtcaattgacggttatttcattacaggttatattatatgctgtacgaaatccccgccaattgtcttttttctgcctatctaagatcttttgaatagtgaaacgatccataataaaacgattgcaccgattgtggacatgaccagactgccgatcactccgtttacactgagtccgagcaggccgaatatccatccgcctaatacaccgcctataatacctactatcaggtttactatcaacccgaatccacttcctttcaatatcttcccggccaggaaacctgccaggataccgataataatcgaacctataattcccatactttttattttattagttttgtagatagaacaagcgagcggcaggctttgttttcccatctcctgtagatattaaaagaaccatcataagcccgaagcggactgtttgggatgaaagtttacccgggtgccgatgttttctttgttcgacaaaggtcgaacagctgtccgagccgggtcagacagctatcccacaagtgtcagacagctatcctacaagtgtcagacagctgtccgacctttgtcgaacgaatatttctccacgaggtagggaatatttcttcactggttggtcggaataggatgcgggaagttcgggttttgatcgggtagagtattttcgggattgtactctttttttagtttatctttattgaaaaaggcggactctcaaagaaatttagcaggttatcctccggttatgcatgttatttcgtcaattttgtttttctttgcggaaaatttcagtcacgtgaatttaattatagaacaaggaaacacctcttcaaaagttgcggtatacaacggatggcatatggaagcctcctttgtgtacaagaaattcgatgttgatgaattggagtctctctttgggaaatacgattttaaacatggaatattgtcgactgtcataggcaaaaatgaagagctgaacgattacctccggggaaaacttcagcgctttatctttctggatgaaacagtaaagttgcctattacggttcaatatgaaacgcccgaaacattggggaaagaccggttggctgcggctgtcggggctaattacctggaaccgggaaaagacctgctggtcatcgacgctggcacagcaattacttatgaattgattgaagcttcaggcacttttctgggggggaatatctctccgggaatgactacccgtttcaaagctttgaacttttatacaaaaaaactacctttggtgacggaacaggaggagatcccccttatgggcaccagtactgagagtgctattcaggcaggagtagtaaatggtattgtttacgagatggatggatacatcgagatgttacggataaaatatcctaaccttttggtttttttaacaggcggtcattcgttttattttgaaagacggctaaaaaactccatctttgcagacattaatttagtgttgacaggattaaacagaatcttagagtataatgttgaagattaataagctactaatagcaagcattcttatatttacgcagttgtcgctagcggcacaaaataacactaactcgccctatacccggtttgggtatggtgaattagctgatcgttcattcggagccggacgggcaatggggggcgttggtgtcggactgagatcgccgaaacagataaacccaatgaacccggcgtcttatagctgtatggattcgttgacatttctgtttgattttggagcatccggccaactttcatggttcgatgacggaatcaataagcaaaataatgtgaatggaaatgtagaatatatcgctttgcagttcccaatacataaacgtttagccatgagtgtcgggcttttaccttattcgtatgtagggtatagcttcggtgcacaaagaacgaatgaggccaatctgaattatgtggaaacatataatggatccggcggattaaacgatttgtatgtaggattgtctatagatatatggaagaagcgtctttctgtaggagcaaatttcggatacttttttggtaatatcaagcatgaacagtattctattgtaggtaccggaaatacatacaatgcgaaccggagtcagaatctggaagtgcgggatttgaaaatggatttcggagtgcagtatacacacccgatcagtaaaaccgaagaggtaactctgggtttgaccttttcaccgaaaaaacggttgcattcaacgtataccaatacgtctgtgaagtatactgaaaacggagcttcggaggttatcagttccgatacactgaaaaaccagacttatgatattccgaattcattcggttttggtgcctcttacgtaaaaaaggataaattgacattggctgcggatgtattgtacgaaacatggggtaaggctcatttctacagttcggataataactttaagaatcgtgtacgtgtagctgccggtggtgagtttattccgaatgctcaaaatcgtaatttcttcagccgggtaagatatcgtgcaggtgcccattacagcaactcttatctgatgataaataatgaaaaagaggatcctgcttataaaggtaacgggtataatgaatatggagtaagcgttggtatgggattaccgttgattgataaccgttctctgataaatgtgtcttttgaatacacaaagattaagcctggaggtgtgaatatgattgacgaacagtatttccgttttactgttaactacacatttaacgaaatgtggttctggaagaaaaaagttgaataatttaaattgctaacttaaattaaaaacagatatgaaaataaaggtattattgattgccgctgcatgttccttaggagcatttggcgctcatgcacagaaaggagtagataatggtacgcagttcggatctggtgaagacagtatccgttgtattaccaatatcagcttattcgttccttatgcgaaagctggaaattttaaggacgcttacgatttttggaaaattgtgtacgatgaatgtcctgctgcaacaaaggatatttatttgcatggtgtgaagattatggcgtggaagatcgccaatgaaaaggatccggctaagaaagctgctttggttgacgacctgatggccgtatacgataaacgtgtgaaatatttcggtgacgacagacgttacggaaaagactggattgtttctcgtaaagcacaggattatatccagcagatgggtgacaaagccgattataagaaactatacggctggttaggtgaaattatcaatgaatttggtgacaaaactgaagcattaggcgtttctttatatatgttcgcttcttatcagatgatggcagacgatcctaatcataaaggtcagtatgtagaagattatctgaaagcttcaaaaatcctggatgctcagttgcaggctgcacaggctgctaacaacgaaaaagaagtaaacaacctgactacatttaaaacaagtgtaaacggtgcgtttgctaatagtggtgctgccgattgcgaaacgctgcagagtctgtatgctcctaaagtggaagaaagtaaaaatgatttggctgctttgaaagagatcgtaactttactgagacgtgttcgttgtcaggaaatcgatgcattctttgctgctgccggttatgcttatcaactggaaccgagtgctgatgctgctatcggtattgcaaaacaggctgtaaagaacaaagattatgataaagctatcaaatattttgaagaagctgccaatatggaaacagatccttcttcaaaagctgaagactattatatgatcgctttgcttaattacgaccagaagagttattcaaaagcaagggaatatgctttgaaggctgctgctgcaaattcaagctacgggcagccttatatcctgatcggacaaatgtatgcagcgacagtaaagaatgtattcccgaatgacggtgtactggcaagagctgcctacaatgttgctatcgataaatgggagaaagcgaaacaggttgatgaaagttgtatagatgaagcaaacaaattaattggaacctatcgtgcccacctaccttcaacggaagaagtatttatgcacccggatctggaaaagggtaaacaattcactgttggtggttggatcggagaacgtacaacaatcagataattatgactgaaacgcgttttctttgtaaaacgggaaaatatagcataacaactaccttcgcggtggttgttatgcttcttttatttatggcgtcttgtgggaaagagaataaagaagtggtcgaagttgctttcgatccggaaaatacttatacgatgagaaccactgatgccaccagcttgatctccgactcggggattactcgttataggctgaatgcgaaagagtggttggtatttggtaaggccaaggagcctcattcttattttcctcaaggagtttatgtggaaaaatttgattctttatttaatgtagaagcaagtgtaaaggctgatactgcttactattgggacaagaaaggattatataaactgatcggtcacgtgagtatattgagcttggaaggaaagaaattagatacttcgatactgtttatcgaccagaaggaagataaaattcatacggatgaatattttgagctgcaggaaggagagaaggttattacaggtatcggttttgagtctaatcaaaatatgacgaagtataagatatttaattcacaagggactttccctgtaaacgaagctcctcgtgactcgtcgagagtgaatacagcttccgattcgacggttatggatgtggcaaaggccgattcaataaaaaaagattagtgtgaatgcattgacgtacatattaatatcattagctttctcagcttttttttcagggatggagatcgcatttatctcttcaaacaagctgaggcacgaactggataaaaagaataaaactatagccggaaagatactggatatcttttaccggaatccgaaccagtttatttctacgatgctggtcggcaataatattgcgttggttgtgtatggtttgcagatggcaattatattggaaccattcattgcaaggttcgtagacaatgaagcgctgatcgtattcgtacaatcgatcatttcaacccttttgattttattcacaggagagtttatcccgaaaacgatctttaaactgaatcccaacttttcactgaacctgttttcggtacctctattcattatatatatattattatatcctatctccaagttttcagcacttgtttcgtatctgattttaaaactgataggagtaaaggaggtatcaggttctacggcccgtacgctgggcaaggtggatctggacttttttatacaacaaagtatcgacgatgctccgtccaattcggatatggatacggaagtgaagatctttcagaatgccctggacttctcaaatgtgcggttgcgcgattgtatcgttccgaggacagagatcgttgcttgcgacacaacagtcaatatagaggaactccgttctaaatttattgagacgggtttgtcgaagatattgatatataacgaaaatatagacgatattataggttatatccattcttcggaattgtttaagaacccggaagattggacgcagaatataaaagatatttccattgtgccggaaacgatggctgcgaataaactgatgaagatattaatgcaggaaaagaaaagcctggctgtcgtggtagacgagtttggcggtacatccggaattgtgactttggaagaccttgtggaagagatcttcggagagattgaagatgaacacgacatgaagtcgtacgttgcccgaaaggtggcggatgacgagtatcttgtatccggccgtatggagatcgattcattgaatgaaaagttcaatcttgagcttccggagtcggacgactatgtgacgattgccgggtatattttacatttctatcaaaaatttcctaaattgaatgaatcaatcgtaattgataagtatacgttcaaaataataaaagttacagctacaaaaatagaacttgtacgaatgaaagtaggtggttaatgaaaaaaaacggaataaaagatgtaacaaatcctttttttcgtatcttcgtgcccttaaactgtaaaatataaactttaaaaataaataacgataaatggctacgctggaaaaaatcagaagcaaagcaggactgctcgtactcgttgtggggttggcgctgttcgcttttatcattggagactttttgaactccggttctacttatttcagacaatctcaggagagagttgctaaggttgacggggaagtaattaaaattcaggattatcagggacgtattgacgaaatgaccgagatgtataaaatgcagtctggtcagagcagccttcctgaggaatatatgaatcagatccgtcagtcggtattcgatgcgatggtacaggaagttgtactggatgaagcaactgataaattaggtatgcaggttggtccggaagaactgtttgatatggttcagggtgaaaacatttcaccgatgatccaacagatgcagatgttcgttaatccgcagaccggacaattcgacaaaacagctttgttgaacttcctgaagactatcgatgacgataatatcgcaaactatcctgcagaccagcaggcacagttgatccaggctcgtaacttctggttgttctgggaaaagaacatcaaacgtcagcgtctggaacaaaaatatacaactttgttaagcaaggctgtttctgcaaatgtactggatgcaaaagaagctttcaatgatgtttcagaaaactcagacatcgtatatgctatgcagtcgtatgcaagtattcccgattcgacagttgatgttagcaagagcgaaattgaaaagctgtacaaccagcgcaaagagctttacaaacaaaaagaaggtaaggttattaaatacatcgctgttgatattcgtccgagccaggaagactatgacaaagcgagtgcagatatcgaatctttgaaagaagaattcaagacttcagaaaaggttgctgatattgtaaatgaaaattcggaagtaccttatatggatgctttcttcactgaaaatgcatttgatccggaaatgaagcagttcgcaactactgccgaagttggtgctgtgtacggtccggtattcgataatgacaaatacagaatgtttaagctggttgacaagacagttgctcctgactcggtaaaagtaagtcatatcatgttggctaacacgggtgacgaagctcgtacaactgttttggctgatagcttgatgaacgtactgaagaatggtggtgactttgctgaactggcaaaacaattctctgctgaccaggctgctgaaaatggtggtgagctgggatggtttacagaaatcactgcactgagaggtgtaaacgacgatttcaaaaatgccgtattctcaactccggtgaataatgtagtaaaagtaaaatctttatacggtactcacttggtaaaggttactgaaaaaacaaataatgtgaataagtacaaggtggctgatatcgatatgactgtatctccgagctctaaaacttatagcaacatttacaatgagttgaatcagttcatttcaaagaacagcgatctggctaagttggatgatgcagctaaagaagctggttataacctgatctcaggtgtaactgtaacagccgacaaccagactttgggtagcattaaaaattctcgtccggtaatccgttgggctttccagaacgataaaggtaaaatctctgagatcttcgaatgtgacgataagtttgttattgcaggtgttgaaggtactttgaaagaaggttatcgttctgttgcttctgttactccggctttgagagctgaactggctgctcagaagaagggtgaaaagatcgcagccgatctgaaagctaaaaatctgacatctatcgatgcttatgcagatgcaatgggttcaagagtagactctgttaagtttatcaactttggaacacgtcgtattgccggtatcggtgtagaaccgaaaatgaatgcaatggtttctattgcagaggttggtcagttgagcgaacctgtaattggaaacaatggcgtatatgtattcaaagtatatgacagaaacaaagatgctaaagaattcaatgaagctgacgaaatccgcacattggatgcttctaacgcatatcgtttcggcttccaggctatccagtcactggtgaacaaagcagaagtagaagataaccgagtacgtttcttctaatttgaaataaagataacaaaaggtaataactctacctttaatagaaagctgccggacttattcagaaaagtccggcagctttttttatctttgtaccggattaatcgttatataaataaaacaatgcaagagaaaagacgattgttgggcatgacgctggacgaactgaaggaggtggctgcagagaccggattacctggttatgctgctaaacagatggccgactggctgtataagaagaaagttacctctatcgctgaaatgactaatattgcggcagctaaacggacacaattggaagagtcttttgaagtgggtgccgttccgcctgtagattgtatgaagtcggtagacggaacgataaaatatttgtttgctgccggtactggtaactttgtcgaggctgtttatatcccgacagacgatcgtgcaactttgtgtgtctcttcccaggtcggatgtaaaatgaactgtctgttctgtatgaccggaaaacaggggtttacaatgaaccttacagctaatcagatactgaatcagatacaatctctgccggaatccgacagtctaacgaatctggtctttatgggaatgggagagccgttggataatgtggacgaactttttaaagttcttgagatcctgacatcctcctatggatatgcctggagccctaaaaggataacggtttcgacaatcggtgttgccaaggggttgaaacggtttttggaggagagcgactgtcatctggccgtaagcctacattctccttatcatgaagagcgattgtcgttaatgcctgtggaaaaagcttatccggcacaaagtatcatcgagttacttaagggatatgatttctcacaccagcggcgggtgtcatttgaatatattgtttttaaaaatttaaacgatagtccgcaacatgctaaagcattgatttgtttattaaagaccttggactgccgggtaaacctgatccgttttcatgctatacccgatgttccgttggaaagttcggatctggtaaagatggaaacatttcgcgatatattgaataatgccggaataatctgtacgattcgggcttccaggggggaagatatatttgctgcttgtggaatgttgtccactgctaaaaaacaacaaaagggatagaatacaagtcatttaagagaaaagaattatatttgtgttataaaagaatgggtatgaaaaagatttctttactgattagcttatccgtgtttctggtattgctgggagcatgcagctctgggtcggttggaaaacgggctacaggacttgcttatgaagtcgttgttgtaatgaaaaaagcaaactgggatggcccttcgggaatggctgttaaaaaagagctgacatccgatgtcccgggacttcctcaatctgaacccgcattaaaaataacttatgtggatccttctcaattcgatgggttattgacttatgtccgtaatattctgatcgtaaatatcgatcctgctatttatacgaaagcttctgtaagttatgaaaacgaccgttgggcaaatgggcaggtggtcgtaacattaaatgccccttctccggaagctatcatcgaatatacggaagcacatccgaaagcattggtcgatttcttcgtaaagacggaaatgaatcgtgccatgaatcagttgcagaaagattatagtacggtcgttatggataatctgaaaaataatcatgacctgatgctcaatgctccggcgaatatgacttattatcgtgatactactgatttcttttgggcatccaataatgcgaacaccggacgtactgatttaatcgtatatacattcccttatacggatccaaatacttttactgccgagtatttggtagcaaagcgtgattctgtattgaaaaagaatttgccgggagcttttcctgaatcttatatggcaaccgaaacgcgtgccgatgtaagttacacgccgataacagtgaatggacagtattgtggcgtgttacgcggtttatggaaaatggtcggtgatatgatgggtgggccgtttgtcagccatgttcgcctggatgaaaagaacaaccgggtcgttgtggccgaaggttttgtttttgccccggagacagataaacgtaatttcattcgtcgtatagaggctgcattatatacacttcgtctgccgggtgaatttaacaagtccgtagatgaaacgctggatattcctgaaaataagaaataaacaaacataatatatggaagaacgattgataaaggtgggcattacccacggagatataaatggcatcggatatgaggtgatattgaaaacattctcagatgccagggtagcagaactttgtactccgatcatatacggttcgtcaaagattgccgcctatcaccggaaagcactggagctgccccctgtgaatatgaatattatctctcaggcagaggatgccggtgttaaccgcgttaatattattaactgtgtggatgacgagacgaaggtcgagttgtcacaatcgacaactattgccggtgaagctgcttttctgtcgctggaagctgcagtcgcagatctgaaacgtggtgctgtcgatgttttactgacagcaccgatcaacaagcataatatacaaaatgaccagttccattttccgggtcatacggaatatctggaagaacgttttggcggagtaggccggaaagccttgatgatcctgatgaaggatagtttgcgggttgctttggtgaccggacatattcctctttcggaagttccatccaggataaccgtggaagatattatgtcgaaattgcgtatattcaatcaatcgctcaagcaggatttcggaatcgtaaagccacgtattgccgtattatctttaaatcctcatgcaggagacaacggtctgctgggaaaggaagaagaaacgattattatcccggcaatgcaagaggcagagaaaagaggtgtaatgtctttcggaccttatgccgccgacggattcttcgggtcgcagatgtatgataaatttgacggtgtcctggctatgtatcatgatcagggactggctccattcaagacgctggcgatggatgacggagttaattatacggccggtttgtctgtagtacgtacttctccggcacatggtactgcttatgatatcgcagggcagaatatagcttcggaagagtctttccgccaggctttgtatgctgccctggatatttatcagaaccggttgatctatcgtgaagcaacagccaatccactccgtaaacaatattttgataaaggaggcgataatgaaaagctggatcttactaaggaggacgatgatacggatgtatgtcctcaataaattacgctttttgacttcaaactttttttgataagaaaagtttacgtaagtttgtggtttcaaattgcaacatgaattatgtttaaagataaaacgatcgtatatacctccggaacgtttgatatgttccactataatcacctgcggatgatcaattatgcccgtagcctggctgatattcttattgtaggtgtgagtacggatgaactggtctcttcttataaggcgaatcctattattccttttaatgaacgtcttcagatcattgaagcattgaaaacgcctgatattgtgataccgcaacatacattggatcatacggagatagtaaaaaaactgaatatcgatgcatttgttgtgggtgacgactggttcggtaaatatgattatctgaaagatttgggtgtgcaggtcttttatttcccttacggaacaggagtgtcttcttccaacctgaagaaaacgatccatgactcttatgaggaaaatctgaaatatcaacgacatgctaaacctgcaactgtaaaaggcaaaggggaggaataaaaacgactcatggaaaaatatgctttaattaccggtggtacgaaaggtataggtaaagcggtggctttctgtttaggtaaagccgggtataaccttgtgcttacttatgcttccgatccgaatactgcagaacataccagagaggaatttcagcagcaattacaaattaaagtgtttgtattgcaggctgatgtaacagacaaagattccatagaaaaaatatatacttatttgcaggaaagagatttgctgcttaatgcagtagtctttaatgccggccttacctgtcgtgactcttttgaagatttgtcactggaggattgggaacgggtattttttgccaatgtacattttcctgtgttctttctacaacgcattgtcagacgcataaataagggaggcagtgtcgtatttaccggctctcttatgggaattcaacctcattcggtgtctttggcttacggtgtaacaaaaagtgccgtacatgcccttgtgaaaaatctggttaagtttcttacgccttatgagttgcgtgtgaatgcagtggctcccggatttgtagatacggaatggcagaaaacaaaaccggcagagatacgccggaatatagagaataaggtttctctcggtcgtttttgtgatccggaagagctagctgaagtatataagatgttaattgaaaatagttattttaatggcgaagtggtcgttgtagacggcggttattcgtataaataatagatagatgagtaatttggataaggaatacgaagcatcgctgaaatcgatagaaacagaaaatgttgttgaccgggcattttaccgtccgataggtttccgtatagctcgtatgttacgtggcacaggaattaccccgaatatggtaacggtaatttctatatttgttggagcggccgttggttttatgttttatcatgataatctggtctataatatttgtggtatattattattgatttttgccaatatcctggattgtgtagacggtcagttggctcgcctgacaggcataaagtcggctatcggacgaatactcgacgggtttgccggtgatatctggtttgcatctatctatgtagggttcgctttacgtttatcacacgattacggaactcattggttctttgccctggctgtcttgtccggactttcccatctggtacaagcaaatatcaccgactactataaaacgcttcatctttattttataagtaaggataagggtgccgaatttcagtcgttggaacaggttattgcccgccacaaagagatgaagatgggaatcaacaaaacattttatttcctttacaggggatacactttacttcaggtaaaggcaactcctgccttgcagcgtatgctgcaaagcctgcatgccaaatacggggatgatattcctgaaagtgtgcgggtagctttccgtaaacaaagtcgtgaattgatgcgctatatagatctactgacatttaacggacgtacaattgttatgttcattgtggtgttgataggcgaggtctggatttatttcctgtatgaaataatcgtgttgaatatagtcctgctattggctatgcataaacatgaaaagatgtgcgcatcgtttatagaataaataaagtatgaaaaagagcgtagtggacattaatgatttgcaggaagctgccccgttcttcaaaagccgtataggcaccttccttggcaaattattgattaaatggttaagtgtagataaggtaaacagggtacatgctaataactgtcatctgcgtggttctgcatttacttccgcacttctgagtgatccgctgatcgatatcaggtataatctgcataatgcggaaatactggatcatttaccggaaggtgcatttataacgatctccaaccatccgatcggatcggtagacggtattatgttgatcgatataatggcctcccgtcgtcctgattttaaagtgatggtaaatggtgtcctgacaaagatcggagcgatgcaggataattttgtatcggtcatgcccgattcgacaggtaacggaccgaatcctgcaaatatcaatggtgtccgttattctttacagcgactgaaagaaggtcatcctatgggtttttttcctgcaggagctatctctttttataataaacaagataaggcgatccacgatttaccctggacacatagtgtgatccggttgataaaaaaagcgaacgtacctgtttatcctgtctatttcgactttcttaattcccgtttcttttactggctgggaaacataagttggaggatccgtaccctgcgtattccggcagaggcctttaataaaagaggaaaaacagtcgatgtatatgtcggtgaacctatctctccggaagaaataaagaaatttaccgatgatacggcacttgctgagttcctgttcaacaagacttacggtgctaaaaaatgagaaaccgctgatagaatctacttcggatagctggaatttgaattaagatttgtaattttggcagacaaactgaaataattacagatattcaatagatatgatgattaagctagacgtccagcaaataaagcaacgttttggaattataggaaatagcccgggcctgaacagggctatcgatgtggctcttcaggtggccccgacagatttatctgtcttgattaccggtgagagtggcgtcggtaaggagacatttccacagattatacatcagaacagtccgcgtaaacatggacaatatatagccgtaaactgtggtgctattcctgaaggaacgattgactcggaattgttcggacatgaaaaaggatcttttacaggagcattggcagaccggaaaggatattttgaagtggccgacggtggtacgatctttctggatgaagtaggggaattacctatccctacacaagcccgtttgttgcgtgtgcttgaaacaggagagtttattaaggtcggttcttccaaggtattgaagacaaatgtgcggatcgtagctgctacaaatgtaaatctgatacaggctgttgccgatgggaaattccgtgaggacctgtattatcgtttgaatactgtacctattcagataccccctttacgagaacgtccggaggatataattcttttgtttcgtaaatttgcgggtgattgtgcagagaaatatcgtatgccgcccattcgtttggatgatgatgcacgtcagttgcttacttcgtaccgctggccgggtaacgttcgcgaactgaagaatgtaacagagcgcatttctgtgattgaagagaaccgtgatataacggcagatattttacgtttgtatcttcctgatctgaatgtggagaagtatccggtattggttaagcaacaggataatgatcagaagttcttcaacagtgaacgtgagatcctttatcaggttcttttcgatatgaagaaagacgtaaacgatctgaaaaagctggttcacgatattatgggaggaaagatgcagatgcctgttgcagaagagacagcctttgcacatcctatccatccggttcattcttcttccatccaggaagtggaagaagtagaagaggaagaaaccttgtcgttggaagaagtggaaaaagaaatgatccgtaaagcattggaaaagcataacggccgtcgtaagaatgctgctgccgatctgaaaatttcggaacgtacgctttacagaaagattaaagaatataatttggaataatatgtttaagaaaaatgtgatctggttttgcctgttgttagggttgttgctgacagcttgctccatctcgtataagttcaatggagcttctatcgactatacgaaggtgaaaaccatcacgataaaagattttcccaatcaggcacccttggtttatccgcagctttcgcaggagtttaccgaggcgctgaaggatatatacattcgtcaaacacgtcttcagctggtcaatgataacggcgatctggagttggaaggtgagatcaccggttatcaactgacaccgatggctgtcaaggaagatgcctggtcttcacaaaccaagctgaccattacggtgcgtgtgcgttattcgaaccggacaaaccctgatgaagatttcgagcagaccttctccgcttatcaggaatttgatgcggcacgaatgctgcaggatgtagaacctgaatatgtaccgctcattatagaagaaattgtagatcagatttataatgcgacagtagcaaactggtaagattatgaaagcggcagatttatatcaactgatagaaaatccctctctgctgacgaaggagacacttcctcaactgaagcagattgtggacgaatatccttattttcatatagcacggatgctttatctgaagaatctggctgtattgaacgatatgcgttttgctgccgaactgaggaaaatggctgtctatataccggacaggaaaaaattatttacattaattgaaggggaacgttacggcatgcatcttaaaacagcgtcgggcgaagaagtagaaacggccgatgccttttctctgattgaagcctttcttgccgaccgtgagggtgaaggagagcaacaggcttcggatccgacattactattccaaccatccgtatcatcggattatatttactggtctttgacaaaagattccgaaacgcaagaggaggaagaaccgtctgttaaattacagcatcacgatctgatcgattcatttattaaaaatgatgaacagcggataccgggaagtggtttaggtatcaacctcgaaccgggtgaagaagggcagccttcttccttgaaaccggaagaagaggaacaggctcgttctctggatgatgattcttattttaccgagactttagcgcatatttatgttaaacagaaacggtatgagaaagcgttgcaaattattaaaaacttatatttgaattatccagaaaaaaatgcttactttgcagaccaaatcagatttttggaaaaattgattattaacactaaaaaataaaactaaaatgtacgtatttatttctattttgatcctgattgcgtcattactattgatcctgatagtactgattcagaactcaaagggtggaggtctggcttcagggttctcttcttctaaccaaattatgggtgtacgtaagaccacagatttcctggaaaaagcaacttggggcctggcaggtttcgttatcgtttgtagtatcgttattactgcattcattcccagagcaacaacaactcaatctgaaatcaaacaacaggtaaacgaagcagtaacaatcgatccgaacacggtagctcctaacttcggtactgcccagcaaccggctactgcaccggaagaagctccggctgaaactcctgcagaataagatttaaagaatatagcagttatatataaaaggcgttcctcataagggaacgcctttttgtttgaatttatgacaattgtcaatgaggctataggtataatttataaggagggttatttaatttttgtatctttgtcaaaacagataaataaaggcttctgttttataataaacgatatgattatggatatgattaattttgacggacttttgataggtattgctacttttctgattatcggattgtttcatccggttgtggtaaaagctgaatattattggggaaccaagtgttggtggatttttcttctattaggtattatcgggacagtcgcttccttgtttatagaaagtgtttttttatccgctatctgtggagttttcgctttctcttcgttctggacgatcaaagaagtattcgaacaggaagagcgggtattgaaaggttggtttccgaaaaatccgaaaagacaatatccggaaaaataattgtacctttgtggctgtaattaaatagtacagctatgaagaaaaaaaagaaagtctctctgttggacgagtacatcaaggcgaaccgtaaagggagccgggaagcggaaatagagaatcatggacgtccggtaagtcataatcgggtacatgtatcgaaaaaggtttataaccgtaaaagagataaggcagatgcccaggggcgtctgccttacttgtttctatggtctgcgcaggtattttctgccggctgcgcaatgccggtcaattccttgcgcaggtaataccggctacctgcgcggacagtttttattcttctttcaggtaaaggccttcgcgtgacagttgatgatccaggttggctactcccaggccgacgatagccattacagtagccgcgtgtctctggtattccgggatacttttagtatacaggtcacgttcagtatgccatatttcgtcatagctgaagttgtatcctttgaaatccttttccataaatccgatagtcggtactccttcgatcgcgaagacagaagcatccgtacctcccggtgttttgggttgtctgcggggctcggattctttcacttcgaacggatattccggatcgatcttttggataggagcgcatatctttacgaaatcgttatacatcgctttcggtacgctgataccaaccggaggagtgggaccaccgtcgcggttgaagagattggatatcttatccagttttttcgggttaccttttacccaggccgttgcaccgagcaagccgaattcctcgccggcaaaggcgcagaataacattgtgcgtttcggtttggcaccggaagtggcgatcaggcgggccgcctccatgacgggagtaacacctgaaccgtcatcaacgcctcctgtgcctacgtcgaacgagtcgaggtggccgctaagcatgacgtattcgctggggtattgacttccttttatcgagcctattacattataatactttacagggccgaggcggaaatgattacgaatatcgaactccagcataaaagaacggcgttcctttaccatctgtttaatggtggcatattgatgctcgtccaatttgatatcgggtacggtcggtaatttatcaatggtcatttctttgtcgaatacgacatctttatcatagagggcacgtaaaggtacagcagccgactggataaaacctaataccccggcctcacacatttctttatagaacagtgccggaacatcttctttgagaggtagtagcgggttgttcgtcctgttctcccagttaccgatcattatttcccggttctttttggctatctcgttattctcggcaatgataacggcacgactggaatcggcagaagaggaatgggcgatcggccatccgacattatttccgttgaccagtacccaggcacctttcaactggcctttcatgcggtcgaactcttcctgtgtgcggggttccagaagaacatggccgcgttgcaacccttttgtaccggaagtataggaaggtgtaacaaagtgaagttccatcccttgctctccgagaagtttaccgaaccatgggccccggttgaagccgacgggcaatgttccggcttcctgcaattcaacttccaggccccattctttaaacttggatgctacccattcggtggcattatcgtaggcatcggaaccgatagggcgaccaccgaaacgattagtcaggatatccagatggttcattacccggttgtcggtacgtcctgtttcgatgattttgtttactgcggcatcctgtgccggcaaggaagatgcaaccatacaggccatagttgcaaaaagaagtatagtccttttcattttagtgtttgtttaagtcttacaaattaatggataaaaaagactcttaccaaatgaaaagagaaaaataatcatagaatcgttacataaatgtaaaagtataaccaaaataaataaatacctttgcaacaaaatcgggagcgtgtgaaatctatctgtaatgccatagcaaaatatctgctggtagtactctttgtaagttactacgtggggggcactgcatttactcatacccattatttcccgacctattcgattacccactctcacccgttcctgccgggagcggacggattaccgcatcacacgcatagctctgcggcattcaataccattcaggaactggatgatctcctgatggaggcggcaaccttttgtcttgccttggtgacggcctgggtacttctctctgtgtttattcagaaacaccagtatacaactcctgtacgtcttgtacgtgatgtcagcctgcgtgccccgcctttgtattaataatctatttgcgacgaaaacagaattatttaatacaacataacaacaatatgaaacaattacttatgctattgcttccggcaatggtgttgtgttcctgcaactcaaacaagcaggacgatgaggttgctgttgccgtaactttgcggggcgacacgatacaaataggggataaatcaccgatcttatcccgcttgggaaccgatgtggtgaagaaagaagcctatcgcctggagttcaccacttcgggggtagtaagggccataccttccgattatgcggagattgcttcgccgttcgccggccgtatctccaagtcgtttgtgaggttgggacagaaggtgatgccgggcagcccggtattcgagattagttcaccatctttctttgaaacgggaaaagcctattatcaggccaaacaggagatggaattggctttgaaaagcctgaaacgtgaaaaagacttattacagaataaagtcggtgtacagaaagaactggaagaagccgaagtaaactatgaactgaagaagaaagactacgaaaatactgtcgctgctctgaaggttttccagatagatcccgaagacctggtactggggcaaccgcttgttgttcgctcgccgatagccggagaggtggttaccgaccgtatcgtgatcggccagtatatcaaggaagatgcagaaccggtagccgtcatagccaacctgaataaagtatgggtagccgcccatgtcaaggaaaaggatatgggaatgatacaatcgctggacagtgtggagatccgtctggtcgctatgccccaccaaccgcttccggggaagatatatcatatcagcgaaatgctggatgaggatacccgctcggtggaagtactgatcgaatgcgacaacggttcccacctgatgaaacccgctatgtatggaacagtccggctgtgcgaccgtagcgctgaaatgatccgtatcccggattcagccatccttcaggaagaagaaagtgcttatgtactggtctcgctcggaaacaactgctaccgaaagcaaaaggtctcgacctctgtcagcgaaggagggaagacggtgatcctttccggccttgttcccggtgataccattgtgacgaccggagctttttatttacttgatgcccggtaaccagtatgaaaaagataatttatactgcgatacatcggcgtggactgatgttcgtactattcctgttcctggccgtagtaggatactattcatggacaaagctggcgatcgacgcttatcctgatattgccgataccaccgtacaggtagtgacacaggtgcccggcctggctgccgaagagatcgagcaacagatcagtatccctatcgaaagggccatgaacggtatgccgggactgaatgtgatgagaagtaaaaacaccttcggcctctcgacggtcgtgttggtgttcgacgacggtatcgacgattactgggctcgtcagcgggtacaggaacgtttggttgatgtagaacttccgtatgatgcggtgcctggacttaacccgttgacttctccgaccggtgagattttccgttatgtactggaaagcgaccagttggatatacgcgaactgaccgacctgcataaatgggtcgtcattccccgtctgaaacaggtgacaggcgtggccgatgtcagtaacttcggaggtatcaccacccagtatcagatagaggtgaacccgcataagatggaacaatataatgtgacactgggagatatcaccgagaagattgaaaagaataacgtaaacgccggtggcagtatgttgagccgtggcgacctgagttatgtgatccgtggtattggcctggttaaagacctgaaagatctgggacgtatcgttatcaagaccgagaacggagttcctgtctatctcgacgatctgggaaccttgaaatacgggaatctggaacgtaagggcgtattaggttttttcgatggcgtgcgcgactattccgatggggtagaaggtattgtgcagatgcttcgcggcgagaacccatcccaggtgctggaaggagtgcatcaggctgtggacgaactgaataacgagaccttacccgaaggaacccacctgcatgtctttatggatcgtaccagtctggtagatacgactttgcacaccgtatcccatactctgttagaaggaatggtgctggttgtattggtattgatcctgttccttgggaattggcgcggtgctttgctggtagcacttaccatcccgttgtcgttattgatcgcttttatcctgatgcaactgaccgatattccggccaacctgctctcactgggagctattgatttcggtattctggtggacggggcgatcgtgatgatggaaaccgttctgaagaaacgagagcgacatccggacgaggtgctgacggaggactctattttgcggcgtaccacagaagtagctcgcccgatcttcttctctacattaattattatcaccgcttatcttcccttgtttgctttcgaacatatcgaaaagaagctgtttaccccgatggcttacactgtgggttatgccttgttgggtgctttggctgtcgccttgtttctgataccgggactggctttctatgcctatcgcaagccacgcaagatctatcataaccactggttggagaagatgggagagatctatcataagcagatcattgccttattggataaacctaagcgggtattgatgccgttacttgttattcttgttgctgccggtgtgttaagttatacggtagggaaagacttcctgccaccccttgacgaaggagcaatctggatacaggttcagttgccgcccggtatttctatcgagaagtcgaaagagatgggagccgaactgcgcaaagtagtgaaacaattcgatgaagtctcttacgtaatgacccaggtaggacgcgatgacgagggagccgaagccttctctctttcccatatcgaatgcggggttggcctgaaaccgtacgatacctggaagttcggtaagacaaaagcagacctgatcgaggaaatgtcggagaagctttcggtcatgccgggctataccgtcagtttctcacagccgatcatcgatatggttatggaccagattgccggtgcacatagtgacctggccatcaaggtctatggcgatgatatcaccgatacccgccatatcgccgacaaggtagtgaatgtattacgaacgatcccgggagccgcagatgtcgccatcgaccaggaaccgccgctgccccagttacaaatcatcgccgaccgtgaccgtattgcgcagtatggtctcaatttctccgacgtcgccgatatgatcgagctggctatcggaggaaaagctatctcgcagatctttgtcggcagtaaaagttacgatgtgatctgccgcttcgacgatgctagccgtaactcgcccgaaagcatcggtaacctgctgttgacgaacggagcaggggcgaagatacccctttctcaggtggctgatgtgaagatgactaccggtgccagtactatctcccgtgagatgaacaagcgtcacctgacgatccatgtcaaccttcgtggtgtagatctgaccgaattcctgaataaggcgaaccgtctgatcgataaggaggtgaagtatgatcacgacaccgtacacctgcaatgggcaggacagttcgagaaccaatatcgtgcctataaccgtctggcggctgtcgttcctctagctttgggtattatgttgctcttgttgtttgccgcctgtggaaagttccgccaggccgccctgatgatgtgtgtggtaccattggctcttttcggcggcatgctggcattgaatgtccggggaatgacgctgaatgtatcttccgctgtcggttttattgcgttgatcggtgtggctatccagaacggtgtgatcatgatctcccatatcaataacctgcgtagtcgtgaccgcggtttcaagcagtctatcattacaggggctaaacaccgtttccgtccgatcctgatgacggcgacggtggctgtgctcggtttgctgccggcttctttgagcaccggtataggttcggatgtgcaacgtccgttggcaaccgtcatcgtgtatggtctgctgtttgcaaccgttatcaccctctatgtgcttcctgctttgtattatctggtagaaaagcattatttagatgaagatacgctacctgttaagccggaggatacgactgtttaggtagggagaaaagaattagaaagtactgataaaaagaataatagatatgcgacaatatattacaatgtgcctgcttgccggaagtttggctgctggtgctcaacagatggtccccctctcgtatcgtgggtatatgcagaaggtgacggaaggtaacctggagtacgcggccgagcgcctgaatgtggatatgtcagaagcgcaggtggttgcttcaaaggtgtttaacgatcccaacctctctgtctcttatttcaacaacgagaataacagtctgcaaatgggagaaggggtagaagtggagttgagtaagacgttctctttcggaaagcgtggggccaatatcgccttggcccgtagcgagagcgagctttcgaaggcattgcttgccgattatttccgtaatctgcgggcggatgcaacggtctcttatctggaggccctgaagcaatatgagttatataaggtaaagcagaacgcttacgagaatatccgccagcttgccgagagcgacagtgtacgttttaagttggggaagatcatggagatagatgccatacaaagccgtctggaagccggtatccttaaaaatgaactgttacaggcggaaaccgatctgcataatgccttttccaacctgaacctgttgaccggctcggtagcccatgatactttatatgtgcctgatgcctctttgcatctgtcacctcgtgatttcgtactggccgacctgatctctaccgcctcggagaaccgtaccgacctggtggctgctctgaaaaataaagaagtagcctcccgcgcattgaaagcaacacgtcgtgaacggaatacggatgtcgatctctctatcgcagtgagcaagaatgcccgggtatataatgaagaggctccggctcctccctttaccggagtcacggcgggcattgctattcctttgaagttttcgaactttaataagggagctgtccgtgccgcccgtttccgggaacaacaggcggagacacaatatcagcaggccttgttgcaggtacaaaccgaagtgatgcaggcttaccgtagttatcaatctttgacgcagcaggtcggccattacgaaaatggcatgctccatgctgcccgtgaagtgatagacgggaaggtgtatagctataatcggggagaagtttcccttttggaagttctggatgcccagcgaacctatgatgatgtacaggctcaatacattgaaacactgtttaattacagtaccgcgcttgtagagttagagaagagtgccggggtttgggatgtggagatgtaataattctgaattatatttatctttgtgaccaaataagagatacgcgtatgatattttacttttcaggaaccggtaactcccgttgggtagcgaatgcgttaagcattgctttgggagagcctgtagtatcgatagcagatgagttaaaaacaggtaaagaggaatttgtctgcccgctcagggaggacgagaaagtactgtttgtttacccggtgcattcgtggggaccggccgttcctgtaactcgctttatctctggtctgaagctgaccggatacgataaacagccggtttattccatctctacctgtggcgacgaatgtggctacacggatgatataatgcggaaagtactgcggaagaaaggtgtcatgctaaccgatagctattcagtcattatgccgaataattatatcctgttgccaggcttcgatgtagacaataaagaggtggaacaagagaaactgaaagatgcaccttcggctgtcaacgctatcattaccgctatccgcgaaggtaaaaacgttaatttatacaagaaaggaagcctgcccgggctgaagagctactggatatatcctctttttactaactttgccatagggaagaattcctttcgggtgacggacgactgtattgcctgtggcttgtgcgaacgagtttgtccgaccggaacgatcacgctgaccgacgggaaacctgtctggtctgatacctgcgtacaatgtgtcgcttgtattcatcgttgtccggtgcgtgctatagagtatggtaagatcaccttgaagaaaggaaggtatcatcatcccgatgtcaacaataaaaaataaacaacgtcaaatgaagcaattattaatgatggttatggccatctttctcctggctagttgtcaggaaacacctaaaggctatgtgataaacggagtcgtggagaatataccggatggcgaaatctatctgaaatcattccgtaataaaatgttcttcgatgtggatactgccgagatcaagaacggtaagtttacattcaaaggtgaagtagaccagccacttctgtatggtctggcaaccgagaatatgaattatccggtacagttctttgtagagaataccaatatggatgtaacgatcgggaatgacggcgagacaattatcgtacagaactctccggtgaatgccatcttccaggaaaaccagagtaaggtttttgaagaaggtttcgatatcgacagcctgatcagcaaatacccggactctccggcagcagctttctatctgtatcgttacttcacctatcagttgccattggatcagttgaaagcgactcgtgcaaagatctctccggcattggctgattgtccttatgtaatagacctggacggtatcatcaaacaactggaaaacgtacaaatcggcaagacggctcccgagttctctttgccggatactgccggtgttgcagtttccctggctgatttccgtggtaaatatgttttactggacttttgggcttcctggtgtcctccttgccgtcgcgaaaatccgaatgtcgtgaaagcattccaggattataaagataagaactttactattctgggtatttctctggataataataaagataaatggttgaaagcaatcgccgacgacaacctgacctggacacatgtttccgacctgaagtattgggactcagaaatccccgctttatatggcgttcgtggtatcccatccaatgtgttgctcgatcccgacggtgtgattatagcaaagaatattaccggcgaagagttacataataaattgaaagaagtaatcaaataggcatgaagcgaaatctgcttatatccttttttaatacaattcttcctaattgattaaaacaaacgactttctccggttgttctagtagggaagcaaaatagattaaaaaaggagatgaagatcgcaattagtggtaattccggttttataggacggcacttgacggatttcttttctgacaggggaaacattgttgtccctttgaaacattcgatgtttcgtctcaagaccgatgataaattgaaagaagcactaaccggatgtgatgttgtaatcaatctggccggtacgacaatcaatcaacgttggaccagtaaggctaagcgtgaaataaagaacagtcgtgtttatacgacgcggcggttggtgtcgatcctgaatgagatgcctgttaagcctaagttatttatttcggcttcagcagttggtatttatccggataaaggtatttattcggaaacaagtacgtcggaaggtaccggttttctggctgatgtctgtattcgatgggaagaggaggcgcagaagctgtcgcgggatatacgattggtcgtggcccgtttgggtgtagtcttgtcgaaggacggtggggctctgccgaagatgttacttccgttccgcttctttgtcggtggaaagatcgcttccggtaaacagggattttcgtggatacatatagaagatgtattaaatgccatccagtttatcattgaacatgaggatctgtcaggtgtcgtgaacctggtttctccccaaccgttgacaaaccgggcatttacccgtgctaccgctgacgtattgcatcgtccggcgtggctgactatccccggaaaagtgttccgctatctgtatggggaaggagaagaacttctaactaaagggcagcaggcttatcctgcccgcctgctttctgccggctatgtgttccgttattcggatatacggttggctttgtatagtttcctgatgtgaagtagatagtttacgcattgataataaataaaaaagcgatccctggttaacagagatcgcttttttcacataacagtgtctatttatttgtaactatatccagctttcttttgtgcactgttggcattttctgccggaatcaaagtgaacccccacttatattcctggtttgcaggtaatgtgtattgaggttcgggacgggaataccagctatcgtaaccggccaatccctcttgtttcaggtcgacacatacctctacgaaattacgtggggtgatatcgttgatgtgtgtctggcgaggtttgtcgtacgggccgatattcggacggttgttaatttcttcctgcgtgaagttgttccattgatacggacggttggttgtcttaccggcatcaaagtcttcaacggagttgcgcattgcattgaattccatttcgtcgtcggctacgatcaacaggtttttacccttaccccccagtgtcatccaacgggtatcgcaatggtgaccgttttcctgcggacgaacataagggaagtattgatcttctgctgtgctcttgtattgtccgatcatgtaaccggctttacgatcccaatagttttctaacggaccgcgtccgaagtattccagttggttcatagtgaccggcaggcggaaacgtacaccgatacggggaacaaccattttatcacgttcgcttaccttatcacgtcctggcgagaacgttgctgtggcggttgcttcggagataccgatctttacgccatccagatgagcaggagtgaagtgggtagccacattcataacaccgtcagggtagatcttataagtgatcaggaactggttaccggccggtaatttataatcgacgtttacaatagcattgccgtcgactatttcagcggaggcattcgttacattgaagttacggcttgacaattcccatatttccaaacgtttcgggtcgccgctaccataatcgttatcgttgggtgcacgccagaagttcggttggataccgaaaccttcgttgaagtattctgttccgcccactttataagaagtaacaactcccgctttcttatcgaatacgaagttaaccctggaagatgtaactttcacattgtctccttcttctgataccgtaagtttagggccaccggccttataagcaactttatctgcttcgatcggcaaacggaactggtcctgtgcgatatcgtaaccggcaggaaccagaccttcctgtttggttgatgtaacgacgaagttaaccagataatccgtgccagcctgtggtttcagatcggctacgggaatagttatctcttgtgaagtctgcggagcaagatcaagtgacactttattgctcttgattactttattgttcgctttcactgtataggtaatcatataatccttcagattagtgaagtaaaagcggttagtaatcttgaatacaccattggctgcatttacagcttcgaaacctatattctggtgagtaaacttcacctctgccattgccgggtgtggagtacgatccggattaacaagaccgttgcaaaggaagttaccgtcgctaggcatgtctacaccaaagtcgccaccataagcataatagtcttttccgttctcgtctttaacaagcaaaccctggtctacccagtcccagatccatccgccttgcaggttcggatatttatagatagcttgccattgtccccaaaggttacccgtagagttgcccatagcatgtgcatattcggaaggagctaccggacggtcgctaccttcttttcctatttcttccagccatccggcactcggatattgtggtacatacatatctgtattccattcccacaaagcacgttcgtagtttacggggcggttcatcagttctttatctttattcttaacatacaggtaagtctggtagaagttgtaaccgtttccggcttcgttacccagcgaccagatagttaccgacggatagttcttgtttcgttcgtacatattcattgtacggtccatgtgcggtaacaaccattccgggttattacccagtgagccgcctttgctcaggctataatacataccatgtgactccacattcgcttcatcatacacatataaaccatattcatcacaaagttcatagaacttacggtcttgcgggtagtggcataagcgaactgagttgatattatgttttttcatgatctcgaagtccttacgcatcagttcttccgttacataatgtccggtcagtggattatgttcgtggatgtttacgcctttgaacttgatcggttgtccgttgaataacaggacagtgtaaggcttaccgttgccggctatctgatcgatcggcttgatttcgatacggcggaaaccaacattataaggaataacttccgttactttaccgtcttcttttactgtcatcaacagtttgtaaaggttcggatgttcggcactccaagttgcgatgtcattcaggtcttttgcgaaagagactgttttgatatcgttggcacctacccatagcttattatcggctgttgcaatagattggccttttgcatccagtaattcgtaagatacggtaatgtcttttgcctctttggtgtggttcttaatgtccacagccagcttgaaaataccgtttttatatgtatcgtccagtgtggagatcacgcggaagtcattaactgccaccttcggttgcgaccacaggaatacatcgcgttcaataccgctgatacgccagaagtcctggcattccagataagagccggtactccatctgaatatcttcagtgtgagtacgtttttacccggttgcagatatttattgaccaggaattctgcagggtttttagaatcttcgctgtaaccgacttcctggccgttcacatatacgtaaagacctgatttggctccggcgatatggagatatacatcgcgtccgtcccagcccgccggcacttcgaagtcgcggcggtaaacacctaccggggtcgtttccggcaatagcggaggttgcggattacgtggcttgaactcgtaaccgtggtttgtgtagatagctgtgccatgtccctgtacttcccagttgcccggtacagtaatatcgtcccatgatgcggtgctggcagaaggatctgtgatattagtgggaaggtctttataagagtctacatagaagaacttccatgtaccgttcaataatgaataatacgggcttttttcaaagcgggaagtgagagctgtcgaacggtcaccatatgtcataaatgaggtgcgtggatgctctttgtttacggcaacgacttgaacgtcttgccaatagggcttcgtggtctggggggtagtcgtaccgtcagccagtacagaccccaataagaagcaactgaatgctcctgagagcacggcttttttgatagagtgtttcatctgtatttatttagattggtatagcttaataaaagggtataacaaaagtccgtatgatagcacgtatacttttggtacacccttatgaatttagatacagcttattttgctgcgtagaaagaatatccttcagccacctggcggaatgccagaacaccggcctgattcagctcaacgttcatttccttaccgtcgggcaggtacataacgacttcgtcattgtctttgaacttcagtaatttggttgtttcgccatctgcttcaacgctccagctcttgtctgtttcatcgaataccaggtcaattgctttttcttcaccttccttctggatatggtatccgtcagttttcgtttcaacagtgtaaacgccctctttaccttctattgttttaacagtacctgcatctgcaacagggttgtttccactccagaattcgatggagttaagaaccaatacgtcggcaagcgcagatatttcgtaaacgggaacaatccagaaagcaataaatactaattcgtttacaaacttactgtcgatatttctattccagtccaaaagcttgtttgttaaaccgaacgatccgatacaagaggaaaataatacactgctggctaaagtggtcgccactaataatgttaatccttttttcttcatgaattattgtaattgatgttagtagttaattgtgggcgaagatagtaattatttcggtatccgccaaccagttcatccctgttttctacgggtttggtaatcagttccggaaggttgaatgtcttcgtgaaatcgaggtagaaatcagggtcttcctgggggagaatgaagggttttccggctgtgcctgtctggcagttaaagcttgctatataagggtgtgcccataatccgtccaaccgtttactgctgaaaacaaaccattctccggtggatgaccaggtgtgaaaactttccacattgttactgtttacttcctccatattacgtatattgtttgtcgctaggttgagtagatataattcactttccggatgccagatagagaagttcccatagtcggaacaggtaaacatcaggaactttccgtctggagaaatacgagggaaagagatgcttttacccgtttcggacgcattgaatacacactcgggagtaccgaaactctcatcttctacatgaaaaggaatccggtacaggtcgtaacggatactatcgagcagagtttttttgtctattgctttactccggcaataatacaacatatttccggcagggttccaggtcggaaaggtctccatccacttttctccgtagatggcgctatccgttataagtgaatttgtttccgtatccagtatgaccagatccgactctgaatcggatacttctactgctttaggaccggtagagtgaaagtactgttgaatttcgttgacggaaaaggccaggtatctgcctcccggatgccaggaagcataggctccggagttacccgttcccggtgctttgacttccgtcctgtttatagttcctttccgataaatcaaggtgcctcccagctctccacgtatatgtatcatcattgtctccggagagttccggcagaaggtatggcagttcaggcaacctttctctatggattggttttcgatgaggggagtttcctcgtaggaggtcaggtcgcgctgataaatacccatttggttccacagttcgtagcccggatagagtaagcggtagacgagataagggtctatggctgaatgtgcaattacattggttatatcaggatattgagtccatttaccgttttggaggatacatatccggatataaaacgtattgccggctatttgttcagtcagttctttccatctgtcgggagggataattacggatgactgactgttccggagtgtgatgtaagctttgtctttgcttcctatttccgtgtaaaattcttctccgtcttcctgtatcctgaagttgggaggagctatattggaagggaaggttactccggtgtaatcggggaagatggagacgggtttatcggtctgtacttcaggggttatgcgggattgagtacagctgcatactatgattactagtaataggagcagtctatttgtcgatgattttgtttccataagggctgagaaagttgaggtaataccagtaggtgttgccgaacttgttttttagttcttgcatatcctttttctgataaaggaaataataagttttaaatctctcttctgtggccgggctgattttgaaacccagtttgttgaaggtttcttcatctactcccaggcggtagatgtagagtgcttcctcgtatatccggggaaattccggataagagaaagcccatattcttttcaggttttctgcaaaacggattaactggttgctgagtaatagattgctcatcagatactcgaatgccatccggttagtagagtctttatcacataaataattgagctcggggccaatgttcagtatgttggcaaaacgtactttctctgttttatcgtaggagagcgcttttaatccgggtaactctccggaaaaaagatgtttttctaattcttctgcttgtttatggtagaaaagagagtgttttaattttcggataaaacgcatggcaactttcgggcggcggttgacgatgttataacagatcaggttagttaggttcggagctgtttcgccgaatacaaccatggcttcaaaggcccagcggtgcgcttcgttgatgtaaccgagttgctcatatacataatgtccgtattccgtttggcgactgtcgcttttccagggcaggtataacgattgtactcccattgtttgtggaaagtcgaacaggttgtatgccattttaccggtatggtaaagggcgaggttattgaaatacatgatcagttggttcttgccccggtatcgtcggcaacagtctgcaacctgttcccattgcccggatttgagatgcatttctgcttcaataatcagccgttcacgcatgctgtatgaaaaaataaaaaagtagaatgttcctccggcataaaccagtaaacttaggataatgatggaggtacggtatttcttctttattatatagagagtcacagataaggctgagagtgctggaacaagtataatgacaagtgtaataaccggatacatccatccgcatataagatacagtatggaaatcgccggaataagcaatataagctttaaccggttggatgtaatggaacttatacccagaaaaaacaactggcaaactatcaggccgaccagatgagtcaccggaaagtcgacagacagatattggatcagtaaccagagagaagggaatagggagaataaaaacagatcgtatttttttgttagtctatggcaaatcgtgacgttcaaaagataagggagagcgagtagtaatgcgaaccaggcttttccgatatgaggcaggtaaaagaattgtatacagaaatcggtcaggtaatcgagcggttgtcccggcgtggaaagatggctattcaaataggtttgggtgaaaaggaataaatggtgttgttcatgatagtaaggtatataaaacatcggtccttccaataaaaggaaatagatgagaaaaagtacacagcaaataatatattggatatatttcatttgtacaatcggttatttaatcgaagaaaagaggagggatgttaaatattccctcctctgacatatgtattatagatctaaataaacaagattacttcgtagggtaacccggattttgtcctaaggcagggttcagatcgagttcagcctgtggaaccgggaacaaatagttatgatcttcatatttgctgcctgtcagcttgatgttttctccctgatacaggatacatacttttccttcatctttcgggtccgcattagcagggtcgtctaccattttgtatttcatccccaggaacggagcattcaaaacctctttggcaataccccagcgacggatatcccatttacgcttgctgccttccagtgcgaactctacgcgccactcgttacggatacgctggcgaagggcatcctgggttccgcaataagtgggcttgctcgcatcagagttttgcagatccggcatacctacgcggcggcgtacctggttaacggcatcgaaagcggaagcgtccagtcctgtaatttcgtttttcgcttcagcataagtaagcaatacttctgcataacggattacatgccagtctttacccatgttccatccatccgattgtgggtcgatactcgggtcgagccatttctgttgataatatccggtagctgttgcgtcattatgttgagctacacctgtactaccgctcgatttcaatggagcggtctttactgttacattatacatggtttctccgtcatgcaatacgcaaacttccagacgcgggtcgcgatgttcgaacggattcgtttcgtcatataaagaagattcggaaatcggagcgccatcgatacattcgaatgcatccaccaggctctgtgtcgggttaataccgccccatcccaatgtagggaatgcttcccaaccaatgatataacattcgtcatcttttttaccagctatgttctgtcttaccaggattgcttccttgcaagcttcctgttcttcccagaataatttggcatattgtccggtatttgctgcatcaaacagttcatattcgccggaatccatcactgctttagctgcatcggcggctgagtcgtaatgcttgaaataaagagctgcacgtgctttcattgcattggcagcccctttggttgcacgtccgtagtcgccgctaccccattgtgccggaagatgggcgatagcataatcgaagtcttccattattttggcgtatacttcttctgcgggagtacgtgttatactgcccatatcgtgcaggtcgagcgtgccttctacatacggtacatctccaaacgtctgtatcaaaccaaaatagatatatccgcgcataaagcgggcttctcctatggtagcctctttatccgcctgatcataatcgggtatcaggtcgatcttttccagtaggatattacatgagcgtattgctttatactcgtctgtccaccccatatctcccggatcgtaaatgccttttgaaacattacctgcggcccatttgataccgtgtacggcattgtcagaatcgatatcgccatcgatgtcaccggtccattttcctggtaggatttgtctgtacacatcggcaacaaacattttggcatcattcggcgttttccaatagctgccgtcagatagttcatcctgcggtattctatccagaaaatcactgcatgaagtaaaacccagaaggcttactgctgaaatagctatataaataaaactctttttcatatttctgattgataaactgttatttaaaatccaactttaagacctaatgaaatctttcttacatttgagtaaagaccaccgcgggaattacttggtgcagattcagggtcgagggtatccattccggtaatcgtaaacaggttttcgccggtgataaatacttttacacgtgtcaggttgattttactcagcaatgccttcggtacattgtaaccgagtgtcaggtttttcagacgaacataagaagcatcttccagccagtatgaagagaactggtagttgatctggtcggacatcgtaatacgcgggtaagaagcattgtggttggtcggagtccaacgatccagatggcgttccaatactttaccaccgttgaagaatgcataagccgcttcaccattcacataagcatccacatcgaatgcaccttggaagaataccgacaggtcgaaatctttgtaatataaattgacacctaagccggctgtccagctcggaaactctttaccgataacagtacggtcgttagccaggtcgatctttccgtcaccattcaggtctttgtatttgatatcacccagttgttctgttccggtacgtttcggaaggctctttaattcctcttccgtattgaaataaccgtcggctacatatccgtagtaagaaccgataggatgaccttccaggtaccagaagttatctcttccgtcacccggatccttaccttctgtaccttttaagtctgtcagttcgttatgtacatacgccagattgaacatgatatcatatttgaaatctttatttatcacattattatggaagatactcaggtcgaaacctttattctccacctttcctgcgttctgacgtggtgcgtccataccgaagataccctgcacgggcaggtatagcaacatgtcgttagtagtcttcttgtaagcagccagttcaaaacctagtctgttgttcaggaatgaagcttcgacagcaccttcccagctggtaacggttgcccatttcaggtttttgtttgcgtagcggctttcataagttgtagcatacagattattgcctaatatgtattcctgatatgcatacgaaggtatagtcagatatacttcttcatctttaagttcttcgttaccggtctgtccccaaccgaggcgtaacttcaggttgctcaaccagctgatatctgcattcttcataaactcttcttctgtgattctccaaccggcagagaaagcagggaaggcaccccagcgattgtcggaagcaaaacgggaagaaccgtcaatacgaacgttggcttcaaatagatatttgtcggcaaagccgtactgggcacgggcaaagtatgaacggtgagctacttcgtatctttcttccttgttcgtttgtgtagaggcatctagtgtacttaatgattcctgcaattcattattgccacctcctttacgttcggcttccagtcttttataagtatgttcgatttgttcgaaacctcccaataaacctaagtcgtgtttgccccaggtttcgttatagtttattaatacctgcgtagtgtaccagttccaccaagtctgtttttcgtaagcctcgcggagacctgttgttgcttcgtttttaagaccgtaatttacctgagccttaaatccttcttcacttctttcatcattacgaacagagaataaggctttagcggtcagattcggtaggacatttacctgagcatacacagttccgtttacctgttggttcatgtctcttctaaaaccgtcgcgtcccaataatgcaaccgggttatctttaccgtggtacaggaaagtcccttcttcattgcgtatgccttctatcggagtggcgcggtttgtaaactgggtcataccggaaacacgattccagctatccatcaaagtacctctgtaaccggataaattcaaaccggcagagaaccatttattgatttgtgagtcgatgctggtacgtgcgttgaaacgtttgtagttgtttgcatcgatcataccattttgctgggtgtaaccgattgacgcactataacttgttttttccgaaccaccactgattccaaggtgatgcatcgtttcgatggcattcttattcattgtctctttataccagtcagtgttcggatgtccgtaaggatccgatccgttacgatacaattcgatgtcttgttctgtgaaacgaagcgggttgttcgggttgtcgtttaatgtagcttcattatataacatggcaaaatcggcagatcccagaaacttcggacgcatagtaggtgtagaccaacctacgctaccggaatagttgacactggctttttctccttttttacctttcttggtcgtgatcaggataacaccgttagcagcctgcacaccatagatggcagctgaagaggcatctttcaaaacattcaggctttcgatgtcggatgggtcgatcgtgttcatactacccggtacaccgtctacgataaccagcggactagctgcatttacagagtttttgccacgaatagtaatgctacctgtctgttcaccaggctttccggtgctttggatggcagtaacacccggcatttgtccggccagggctgctgacacactcgatactgggcgggattctatggcttctgcttttacagtagcaaccgaaccagtcaggttggcttttttctggacaccgtaaccaacaactatgacttcatcgagagcctgtgaatcttctgttagtgtgatttttcctttggctgcttcagaggctttaatctctacggttttaaacccaatactactgattaccaagatgtcattaggattggcctccagtgtgaattttccatccagatcggtcactgtgccgttggttgttcctttaatgaccacattcgctccgattagtggctcgttcattccaccgtcgaaaacgattccgcttatggcttttttctgttgggtaatagatacttctgctgtagtggcatacagggaagatgtggttactgaaacaggaaaagcaagtgcgattaaaagcaaagagaattgattttgctttaaaatagacctgtaattcatgtgctttttgattgataattaatactagtgttgttgttaacatagtcctagcagaactcaggcttaatcataattagtaatcgtcagtaccttaatgcgttaattgggattggttaagaatacaagaaaatgaattaactttatcaagtaattaataattaacaaatgtagctgtacgggttgtgtttagttatgtattttaatatatttatgcattgataataaaaaatatactatatttgcagtgtcgtttttaaatagttctgctagaacgatgttatccctgctttctccctcctttaataaattcttcaatttatttctaccctatagattactttggtgaaaatggataaattatcattttgttttcttagatttgtcggatataatataatccaattgtatatgcgatgtgaatcttaccgaatattgatatcgttttgtttgttgttttggggattgtttatttctgcccagatgcccgtccggttaaatgaacgtccaattagcctgagtacttcatcgggaaagatcaatggaaagatgataattccgggaacggcaacttttccgttggttttgattattgcaggttcaggaccaaccgatatggatggtaattcggctgtggctggtatgaagaataattcgttgaaatacctggctgaagagttgggtaggagaggtattggctccctgcgttttgataaacgaggtattgcatccagcgcaggtgccgggaaagatgagtattccatgcgttttgaagacggtataaaagatgtacgcgaatggattgatcttttatcccgcgatcgtcgtttgaatggtatctatatagccggtcatagtgagggagcgctcgtagggatgcttgccagccaggataatccgaaggtgaaaggatatatttcgctggcaggagcggggcggcctatgtcggatctgctggaagagcagatggctgggcaacctgaagtgatacggaaaatggtgatatctatcaacgactccctgaaagcaggtaagctggttccgagtgtgccgctgggattgcaggctttatttcgttcttctgttcagccatatctgatctcttgctataaatacgatccgcagaaagagataaagaaactgactgttcctgtcctgttgttacagggaaaaacagatatacaggtctctgtaaaagatgcagaattattaaaacaagcattaccttctgccgaaattaatttgatagatggtatgaaccatgtattaaaggattgtgcaacgacagaccgtcaggctcagatggctgtttacaacgatcctgaccttcctgtcaatgagaacttgctcttattcattgaaaagtttgtgaagaagccctgaacaattgtatctttgtacctgtaaatagaaataaatatgatttcagttgaaggactaacagttgaatttggtggttttacgctttttgatgacgtatcgtttgtagtaaataagaaagatcgtatcgcactggtcggaaagaacggtgcaggaaaatctacgatgttgaagatatttgcaggtttgcaatctccgacatccggtacggtcagtgtacctaaagagacaacgatcggctatttaccacagcagatgcagctgacggatgcacataccgtcagggaagaagccgagttggctttcggacatatccgggaaatggaaaagcagatcgaacgtctgaacctggaactggctgaacgtaccgattatgaaacggaatcttaccagaaactgatagataaagtgacacatctttccgaacattttcagatgatgggaggaaacaattatcatgcggaactggaacgtacgttaatcggattaggattcaaacgtactgacttcgaccgttcgacatctgaattcagcggtggttggcgtatgcgtatcgagttggcaaagttgttgcttcgccggccggatgtgttattgctcgatgagcctactaaccacctggatattgaatcaatccaatggttggagaactttattgctacccgtgccaatgcggtgattctggtttctcacgaccgtgcttttatcgataatacgactttccggacgattgaaatcgaactgggaagtatatatgattataaagtcaaatattccgaatacgtggagctccgtaaggaacgccgcgaacaacaacttcgtgctttcgagaaccagcagaagaaactggccgatacggaggcattcatcgaacggttccgttataaagccaccaagtctgtgcaggtacaatcacgtatcaaacagttggaaaaggtagagcgcatcgaggtggacgaagtggatagtgctatgttgagcctgaagtttcctccggctccccgctccggctcttatccggtaattatggaggatgtggcaaaaagttatggtgaccatctgatctttcaaaatgttactctaacgatcaatcgtggtgataaagtggcttttgtggggaagaacggggaaggtaagtcaacccttgttaaatgtattatggatcagatagattacgaaggtaaacttcaactgggacataatgtgaaaatcggttactttgcacaaaatcaggcacagttgcttgatgataacctcactgtattcgatacaatcgactatgtggcagagggtgatatacgaacaaaaatacgtgatatactaggtgcttttatgtttggtggtgaggcctccgacaaaaaggtgaaagttttatccggtggtgagcggagtcgcttggcaatgatccggttgctgctggagcctgtaaacctgttgattctcgatgagcctacgaaccatttggatatgcgttcgaaagatgtattgaaagatgctttgcgtgagttcgacggaacggtgatcgtggtttctcatgaccgtgaatttctggatggactggtagataaagtttatgaattcggtaatcagcgtgtgattgaacatctgggcggtatttatgaattcctggaaaggaaaaagatggatagtctgcgcgaactggagcgtactgttcagtctgcatcttcttcaggtgaaacggaagatcagtctactcagaataaattatcgtatgaagctcgtaaagaacaaagcaaggcgattaaaaaagtagaaaagtcagtggctgaagctgagaagaaaataacaggacttgaaacttcaatagcagaaatcgaagccaaactggctacaccggaaggtgcttccgatacctctttatacagcgattactcttctttgaaaaaagaactgtcagataccatggatacatggacagaactgaccatagagttggaagaattaaacgaaaaagcatcccggtaatccggagataaataacaaacgcctaatttattatagacaaatattatgttaactcaaattattaatggtcgtatcctgacaccacagggctggatgaaagatggttctgtattgatcagtgataataagatcctggaagtgacgaactgtgacctggccatagtcggtgcgaatttaattgacgccaagggaatgtatatcgttccgggcggtgtggaaatccatgttcatggcggtggtggacgtgactttatggaaggaacggaagaggcattccgggctgcagtcgccactcacatgcaacacggtactacaagtattttccccacattatcttcttcgacaatcccgatgattcgtgaagcggcagctactacggaaaaattgatggcggaaaaagatagtcctgttctggggttacatttggaaggtcattatttcaatatgaaaatggccggcggtcagcttccggaaaatatcaagaatcctgatccggaagaatatattccgttgttggaagaaaccaactgtatcaaacgttgggatgcagctccggaattgcctggtgctatgcagtttggtaaatatattacatctaaaggtgtattggcatctgtcggtcatacacaggccgaatacgaagatatccagactgcttatgaggctggttatactcatgctacacatttctacaatgcaatgcccggttttcacaaacggcgtgaatacaaatatgaaggtacggttgaaagtatctatttgatagatgatatgactgttgaggttgtagccgacggtatccatgttcctcctacaattcttcgtctggtatataaggtgaagggtgtagaacgtacatgtttgatcactgatgcattggcttgtgccgccagtgacagtcaggtagctttcgatcctcgtgtgattatcgaagacggagtgtgtaagttggccgaccgttcagctttagctggtagtgtcgctaccatggaccgcctgatccgtactgttgtgcagaaggctgaaatacctctggaagatgctgttcgtatggcttctgaaacaccggcccgtataatgggtgtttacgatcgtaaggggtctttacaacgtggcaaggatgcagatattatggtcttggacaaagatctcaatgtaagagctgtctgggctatggggaaattggtggaaggcactaataaattgttttaacgggtagaacaggaatagaaatatagtagaagttatgttaacacaaataataaacggacagatactcacaccacagggatggctgaaagatggttctgtcctgatcagcgatggtagaatactggaagtcacgaacagcgacttggctgtgatcggtgctactataatcgatgccaaaggtatgtatatcattcctggtttcgtggcaatgaatatacatggtggcggtggttatgattttaaagaatgtacgaaagaagctttccacggggcagtgaacgcccacatgaaatatggtgcaacttctattttcccgacattgtctccgctcccaatgacagaagttcagaaagctgtagccttatgcgaaggcgtaatggctgaaaaaaacagtcctgttatgggattacaactggaaggaccgtatctgaatccgaagatggcaggtagcttattgacggatgcattgaaaaatccggacccggatgaatataaatcgttactggaaagtacgacttgtattaaacgttgggatgcgagtcctgaattgccgggggcattggattttgcccgttatgtccgttcaaaaggtcttttggctgccgtctctcatacggaagctgaatttgacgatattaaagcggcttatgaagcgggcttcactcatgcggctcatttctataatgcgatgccaggtttccataagcgtcgtgaatataaatatgaaggaacggtagaaagcgtatttctggaagatgatatgacggtagaagtgatagccgatggtcggcacttgccttcaacgatcctgcgtcttgtttataagctgaaaggtgtggaacgtacttgtttgtctactgatgcattggcttatgctgccaatggtggaaaaccagtcgacgatccccgtattatcatagaagacggcgtttgtaagttggccgaccattcttcattggtaggaagtattgccacgatggatgtgctggttcgtacgatggctcagaaagccggagtacctttggctgacgcagtccgtatggcttccgaaaccccggcccgcctgatgggtgtagacgatcgcaagggttctttgcaacgtggtaaagatgccgatatcgttattctggaccgtaagttgaatgtccgctctgtttggtcgatgggacatttggtggaaggaacgaatacattggcgtagtaccgatttataggtaaatagatatttttgatgggattctttaatcattaattgtttgagaattgttatatttgtagttcaagtaaaaaagttgtactaaatcgtaattaaacatgaagacgaaccttagttctcaaattaccctgacgcgtataccgctcaggtattaccgtccggaaaacgcttacgagcaatcagttttgactcgttttgaaaagattccgacaaacatctatgaatcggcaaatgaaggttctttcgcgatcgcaaaggaactggcatcacaaatacgcaagaagcaggatgccggcgagcagtttgttctggccttgtccggtggacgctctcctcagagtgtctttaaagaattaatacgtttgcataaggaggagcaattgagcttccgtaatgtgattgtatttaacgtatatgagttctatcctttgagtgcatcgacgaacagtaatctgacttacctgaaggaatcgttcctcgatcaagtggatatcgatccgaaaaatgtttattcgccggacggttccatccctaaagatgacatctttgagttttgcagacaatatgaacaacagatccaggttgtaggcggtatcgattatatcctgctgggtgtcggtcatgcaagtaatatcggtttcaatggtccgggttcttctgcaaatgtaggaactcgtttggtgttgctggataacgatgcccgtaaggaagcagccagaacattcaagtctatcgagaatgttcctgccagcgtaatcaccatgggtatttctactatcttgcgtgctaagaatgttatattaatggcttggggtgaagataaagcccgtataattgctaatacagtcgaaggtaaggttagcgaagcggttccatctacttatttacagaatcatatgaatgtaaaggtagttatcgacctgtctgctgcttacgaactgacaagaatcagccatccctggttggttacgaactgcgattgggataacaaattgatccgtcgtgctatcgtttggctgtgccagttgactggtaaaccgatcctgaagctgactaataaagattatagcgaacatggtctgggtgaactgttggcattatatggctctgcttataatgtaaacatcaagatatttaatgatatccagcacacaattaccggttggcccggtggtaagccgaatgcagacgatactaatcgtccggaacgtgctactccgtatccgaagaaggtgatcgtgttcagtccgcatcccgatgacgacgtgatctctatgggtggtacgttgcgccgtttgtgcgaccagcaccacgatgtacatgtcgcttatgaaacatccggaaatattgccgtaggcgatgacgaagtaatccgctattgcgaatacttgcgtgatgtttgcgataaatattctcctaatgatacagcggttaaggataaagcagaagagatcatcaaatacctgcgtttcgaaaaggtagaaaatggcgaacctgaaaagaaagacgttttgtttatgaaaggtactatccgtcgtgaagaagctcgtcatggttgccgctattcaggagtgaaggatgaaaacgttcatttcctggatctgccgttctacgaaacaggtcttgttaagaagaacgatctgggtgaagccgacgtagctatcgtaaagaaactgttgcaggaaatccaaccggaccagatgtttgttgccggtgacctggctgacccgcacggaacacataaggtttgtctggatgcggtattggctgctatcgacgaactgaaagacgaagaatggctgaaacattgccgcgtttggatgtatcgcggagcatgggcggaatgggaaatggaccacatcgaaatggcagttcctatcagtccggaagaattacgcttcaaacgtaatgcgatcctgaaacaccagtcacaggcagaaagcgcaccgttcctgggtgacgacgaacgtttgttctggcaacgtgctgaagatcgtaaccgtgctacagctgaattgtacaaggaactggggctggcttcttatgaagcaatcgaagcattcgtacagtatatgattccgtttgagaaataagaatagtattctaaaaatagagaaggtatcctgaaaaggataccttcttttttaattaataggttgtaccctggaaaatgtttgattgagagtatgggatcaaggttccgaccatagtcaagtttcttcctgagaagttcgggtctactgtaacagtggcccggttactaccgttcataagaaccagattgacggtggcggagatgaagataccctgtacgctcatggacaggtaaacgttaccgtctttatcctgtttgctctgtatattagatgcgctaccttgtacggtaacaccacctaaaccattaggacctggatacggagagttggaagcgatctgaaccattgcctgtccgtcgttcaaagagacgaagtttgtgttagagttcacatagtaaaccattccgttcattggttgtacggagttagcttccaatacaaaagactggtcagtgatagcttgcagggctgtgttgaattcctgttcgtccatgacggcatctcttgcttctctagcttctttcttttcttttctttctaactttttctctgctttttctgcggctttactctgagcctgtacatgtgtcattccccccataactagagtgaaaacgacgataaaagatacaattcttttcatacgatttagtttaaaacgttttcaaaatgtaataaaaaaacaagcaaagggtaaaaaggtttctggtaaataagcgaatacatatactataacattctatcagagttatttggttaatcctcatatttattaaagaaacttttatataatagccggttaggaggcttgtcggctaggtattcagcaaattatccagtacttttgtaggtatgttgaagttaaaaacgagaagatatgaagatagatgtttgtttctcgccggccttgtacccggtatatcataacccggaagcgattgtcgtagtagtggatgtgtttcgtgcaacgacgacgatggcggctgcttttaagagcggagtatgcagtatccgcccggtggcaaccgtggaagaagcgaaggaatataaggaaaaaggctggctggtaggagctgagcgtaatgtgaagcgttgtgattttgcggacttcggtaactcaccgttcgactatactccggagatggtttcaggcaaagatatcatctttacaacaacgaatggaacgcgggctatcacgattgcccgatcggcataccgtgttgtaacgggcgcttttgttaatctgcaagcggtggctgactattgtctgtttcatgggcgtgatgttgtggttttgtgttccggatggcaggataaagtgaatatagaagataccctgttcggtggtgctttggtagatgccctcacttttacaggcaaatacgaaccggcctctgatgccgcaatcattgcccgcgatatgtggatgaataataaagaggacctgattgcttatctcgatccgaccgaccatatggcccgcctgaaagcaaacgatctggctgattcagtaccttactgcctgacaccggatagtgcaattgttgtgccggaattggtgatagaaggggataccttggttttgagaagagtggttacgatttaaataaatagaggaaaaacagaaaggaatggcaacgataaataaaatacgtttcggagtagtcggaacgaactttataacagactgggtgattgccggtgcacgggaggatgagcgttttgaattggtggcagtctattcgcgtacccaggaaacggcggatgcttttgccgccaaacatcagataccttatacatttacatctttggaggaaatggcgcagagtccattgatcgatgcggtatatattgcatcacccaattttctgcatgcttcacagagtatcctgtgtatgaaacatggcaaacatgtattatgtgagaagccttttgcctccaatgcgagagaggtaaaggagatgattgccgcttcccaggagtacaacgtgacgctgatggaggcaatgaaacccacgctaaccccaaacttccgggccgtacgtgagaatatacataagctggggacgatacgccgttatttctcttgctattgccagtattcatcgcgttatgataagttcagggaaggtatagtattgaacgcttttaagccggagttgtcgaacggtgcgatgatggatattggtatttatacgttgtacccgatggtcgtactgttcggtcgcccgcaaaaggtggaggcgacaggtgtagtcctttcttcaggggcagacgggcaaggggcagttaatttcgtgtatgaagggatgaatgcaactatcctttattcaaagatcgctaactcctatctgcctacggagatacagggtgaggatggaaatatcaatctggatcgtataaatataataggaaaggttacttatacccctcgtattccggcgggtgcaggaaagactgctgtttctgagccgatagatataagtgcagtgacagataagaatgaatattattatgaggtggcagagtttttggatcttatacaggccggaaaacgtgagtcgtctattaatagccatgagaattcattgattaccctggagattatcgacgagatacggaggcagttgggagttgtttatccggcggataagtagtggagggggattcactatttgacagaattgaatgttacttttctcttgacagaaaagtaaccaaaagttcaaggctgcacctgcttcgctgctccggtgaaagactacgctgtcgtctgcgaactcgcttcgctcaaacagcgcagtctccttacgcttcgtctttccccttcgcggacgctcacccgccgaaggcctttcagagaacgcaaagcgttctttggggattgccgataccgacacctttaaaacaggcgctatcggccatcctaagaggaagctccgcttcctatgaaaggcctcagctggcgagcgtaaagcgcagcagccgtagagagcgcccggagcatccgctgtttgagcgaagcgagttcggaggcgatagcgaacgcaggatgcggagtagcgaaccaggtgcagccttgatcttttgactacttttggatcaagccaaaagtaggttcaattatttctaataattattcttacccctctctcaaaaaatacttcgccaggaacttccagttctcatgaatgatcgctttcccacgttccgggctatgcaagcttttggtctgtgcatcggctagcatacctcgttcttcgagcgctttcaacaaatccatgctgcaatgtttgacaatgaagaagccgagaccttgttcggaagctttcttttcgtcgtagaagggattcgcttcgtctttgatgaattcgataccgtctactaaaagctgtaatccctctttgggcgaagcatatacggcaaacttgtcgaattcgatgcaatctgccagcggggtatattcgctttcttccagtttcaactgtccggaggcgaagtcgatgaattcctgcttgcttttcatgtaaaagagtagtttgccgtcggcgatctctacgaatttcttatagatatttttgttgctttcttcccgttcctgaatagctggatcgacaaagctttctgcactttccgcactttcaacgaagaaggcatggttcgggtgtgtttccggcaggatcagcgacaaccatttcggtgacgtataggccaggaaggcagtccggtcgatatatgacatcgagttatggatggccataagcgcttcggtattattcctgttctccgggctctggctccagtattccttaagcgtctcactcaaattaaactttgcgtcgacggacaggtaactgtcgtaatggaaccagtgcaatagcggaacgtattgttccggtgtttcgtaggatgtgtccggagcgaagagcatctgcatcttggtattttcgggagcggtagtccattcctggcaaaacagttggtagatgaggcgtgccgtctcttcggtggtagggttatccgggttgacaaaggtacccttttttacaccgtgatactgttggagataatgccaaaggaggaaacggacgtcctcgaagttggcttcatcgtcgtagtaatggtcgctgacggtataaaaagggacatagttgcctgtcagttctttatactgtgtgatgaatgcccgccagatattcaggccggagataacatcttcgaagtaagcagccatacgcatactaacctgtatcgcatcttccttttcgaaggagtttaccaggtcggtatgttccattatttcgtgtatctggttggcgatacgtgtataataaaggtcggtagggccggattgtttatagggatgcagttgcagccagtctttcggatagattttagtgttcttcatataataacatttatgtcttattttaataaaggcacaaatgtagtaaaaattcgatagcgatatgcgtttgtgtgtttctactgaaagatattttaagaagggattagtctgtctttcatgtgttgtcaatgaattgtaataaccgttatcgcattgtcatactttttaaatttaactgaaatattccacctctacttttgcggcaaataaatgtaacaacaagtaaaagaatgagaaataagcgtgaaaagagaggattatggatgctggtcctcctgctgtttggaagttttcttgcgctgacagtccaggcacaaacaggtgttatctgtgggactgtaacggatgctaaatttaaagaaccattgatcggggcgaccgtatccattgaaggaacgactatcggagctattacagatatagacgggaatttccgtattgaaaaggtacagccggggaaatatattttgcaagcttcctatgtgtcttataaaacggaaacgatcaaggatgtggccgtagtgtcccgtcaggaaaccgttttgcggatcgaactgtcggatgccgacctccagttgcagaatgtcgtggttgttgcccaacggaaactgggaacggagacggctgtattgaatacggtacgtaaaagtcttcccgttgtaagcggtatatccgcccagcagatcagtaagacgcaggacagcgatgcagccgaggtacttcgccgtattcccggtatcacgatcgtggatgaccgttttatcgtagtccgcggtctggcacagcgttataataatgtatggctgaacaatgctaccacaccgtcgagcgagacggatagccgtgctttttccttcgatgtattgccttcgtcgcttatcgataatatgatggtctataaaagtccgtcggctgaactgcctgccgatttctcaggtggtttcgtgcgattgatgacgaagaatgtgccggagggtaatactttcaatatctcttatcaacagggctttaatacgaatgctactttccgtgactttcggttgacgaaagggcatgcgatcgactatctgggtttcggtgccggtaaacgtgcgctgccttccggtacgcctgcccatctgaacgatgtaaacccttcggatgctgccgcctttactcgccgggtgaatacgggttgggacatcagccatttcactgcactgccggaacagaaactgacttttacaatgaaccgcctgttcaatatcggcgattggaaggtcggaaatatcaccaacgtgaattatagcacgggatacgattattacgaactgaagaataacaactacttgtcgtatgatatgacgaacgaccggtcgtcttaccgttacaaatacgacgatgtgcaatataagaatacgaccaagctaggcgctttgttcaattggtcttttatgaaaggaaacataaaatatgagttccgtaacttcttcaatcagcgcggttcatcttccctgacacaacgccagggtacggattattattcggaagaaaatatccgcaaatgggaatcgctctacaccggacgtaccacctatgccggtcagctggccggtgagcaccgctggaatgacgacgtcgacaaggtggactggacggccggttatgcctatgcagcctacaacgaacccgaccgcaaagtggtgaagtcgatggaacgtaaacaggatggcgaactgaagtattacgtatccgatcccacccgctattatcaggatctgaaggataacagcttttccctggcaaccaactacgagcatatctttaccgtgtccgatctgttcaaaccgaccttgaatgccggtgtatacggtgaatacaaaaaacgtaatttcgatgcccgtcgttttgtctacaacctgctgggtaacggatacaatcgctttgccgaatgggattacagttcgatcttctcggacgagaatatctccgccgaccgtatttatatgaaagagagtacgaacaaaagcgactcttatacctccgataatctgttgggagcggcttatgtgtctgcgaagctgaattacggggaaaagttgaatgcaaatgtcggtgtccgtatggagtactaccagttgaagctggacggttacgagtcggatggtattaaaccggtgcacctcgatcagagttcgaccgagttcttcccttccctgaatgtggcttacagcctgacggacaagcagcaggtgagggtggcgtatggccgttcggtgaaccgtcccgagtttcgtgaggttgttccctatgtgtattacgactttgctctcgatgccaatatcaccggaaatgtagatttgaagaatgcgtataccaatagtgtggatctgcgttacgagttttatccttcccccggcgagacggtgacgataggcggtttctataaatactttgccgatccgatcgagcagacctaccgtgaggcggggtcgggtttgcagtatacttatcacaatgccgatcatgccaaagcgttcggagtggaagtggatattaagaagcacctggactttatcgggctgaaagacctgagtttcgtattcaacggtgcttatatccatagtaaagtatatttccctgaaggctcttttgaacgcgaccgggccatgcagggacaatcgccttacctgatcaacacaggacttttctatcagaatgacacgaaagggctgtcggcctcgattctttacaaccggatcggcaagcgtatcgaaacggtgggcgtaccggcgcagaacccgaacgacgatatccccgacatctatgagatgccctgtaactcgctggacctgagtttctcgaagaagctgggtaactatgtggaactgaaagccggtgtcaaagacttgctgaactcgaagatcgagtataaacaattcctggaactgactgatgcggacggagcgaaacgtgaagtggaacaattggtccgcagttaccgtccgggagtaaccctcaacgtgggagtatccgttaaattttaattgaaatcacttatacaaactaaattggttttattatgaacaagtttttattgaaaggtgtggctgccatgttatgtatggccacaatgtttggaaacgtagcttgtagcgacgataacgacgatccggcaaaggtgagtgtaactgcggttgcactcgacaaaacaaccttgtcgttaaaaccggcagcaacagctaagctggctgtaacgatcactccatctgaggctacaacaaaaacagtgacctggacttcttccgatgataaagtggcaacagtgagtgatggtactgtaacggctgtcgctgtgggtaccgccacgattactgtaaaaaccgacgatggcggtcttactgcatcctgtgctgtgacggtgtctgaagatgctccggaaggcaaggatgtggtattgcaaggtgagattaaatccgatatgactttaaaggctatagataacaacctgttgagcggttttgtatacgtaaccgacggggttacgctaaccatcgagccgggtacggttatcaaaggagagaaagcgactgaaggttcactgatcgtggaaccgggtggcaagattattgctgaaggtacagttgagaaaccgatcgtctttacttccgatcagcctgccggttcgcgtacttatggtgattggggtggcttgatcctttgcggtaatgcgcctgttaatgcaactaccaaaccgcagatcgagggtggcccgcgtactacatacggtggtaataagcctgaagataactctggtattgtgaaatacgtgcgtatcgagtttgccggctatccactggaaccgaacaaggaaatcaatggtctgaccttaggtggtgttggtagaggtactacacttgaatatattcaggtctcttattgtggcgacgattctttcgaatggttcggtggtacggtgaatgccaaacacctgatagcctacaagggttgggatgatgagttcgatacggattatggttatagtggtaagttgcagttcctgttgggcgtacgtgacccaaaagtggccgatacttccaagtctaatggttttgagtcggataacgatgcgaatggttcaggtaatgagccgttgaccaaaccgatcttctcaaatgtaacgttgatcggcccgttctatggcgagtctgccggtaaagcggaaagcgaaattctttatacaacggatgatgctgccaacggtgcaaagggtggccagttccaggctgctatgcatatccgtcgtaattctgccctgaatgtatataactctgtattcaccggctggccttatggtttgtatcttcagggtgcgaatgcaggtgctacggttaagaacgtgatctttgccggtatgtgggaaaacttcaaggatgatgcaagcaagagttatttcgaaacaaccggcctgaacaatcaggtgtatgcttccagcaacgatctgatagcgaaaaatgcagattattcttctgttgtggtggataagatcggtggtgcagaattctctgatgctgttttgtccgacagcttcttcgacaaagtgacttacaagggtgctttcgacggaacaaacgactggactgccggttgggctaactgggatccgcaaaacactgcttattaatttacttctgttgcttatcgtaattttaaaataatggaggaggggccggaatatgtaacagtttccggtaccctttccctgtattaggatggtaacaataataaatacatgcaaatgataaagaaattattactgacttctacactggttgccggctctgctctggctattcatgcacaggatctcgtcctcagcgaaggacaatattatacggatgccacacaaaccactccatacaccggacgttacaccgaattctacgatgacggtatgttgaagatggagctgtttctgaaagatggccgccccgaaggcacatacgttatctattatccggacggaaagattgccgaagtgcgttcttattaccacggtgtcttccacggggaatggcgtacttataacgaaaacggacagttagtggggctggccagttataaagatgggcagaaagacggtccttggcgtatctggaatgaaaagggagtgcttcgctttgaaatgttctataccaaaggcaaaaaaagcggtgtctggcgtacctggaatgatgagggagacttgttgacggaagagaagcaataactaactgtcatactatcatttttgactttgtgagtattgaaatctaatacttacgagctatgatagttcgtgtgatagttccattttcaactatcatactatcataaaatagcttgacaaaactgactgggtatatgacttattttcagtaaagtagggacttctcttttttgagacccgggtgtaaagggtattgggacccgggtcttagcatcgttcaaatccgggtgtaaaagggcctgaaaaggggatctcaagtagaaggataagtagttttcgtgaaaataatggccatattggggctaaagatgtagggtactattggaaaacagtaggcatttgatcgtttttaatccccttttttgcgatgcattacctctaacaggtcatatgatagttcatgatagttgaatgatggttaaaacggacaactatcatagatatatttattgatattcaaaaggtgtgctgaaattatgatagtcagatagttgattttgaaaacatttaataccaacatccaagtctcaattgacagttagacttcgcgctcgaacatagaaagaattgagctattatagcaggatatgagcttatgtgcccaccggctaactgtccttaataaggcaggcttagttacaggtttatttgccgtcagttttaactgacggatcagtaaatgatctatttctctggactttagtcccattttaaacagtctctttatttacagagaaatgtggctaaagccaaaaaaggagaaacaacttgtaatccgtcagctaaagcagacggcaaatgaacctgtaatggcgaagtctctttgataaggggaagcttcaatgattgctcctatttgacaataactgaaacattcaaacctgtcaaataatgaaacattcatatctgacaatatccaaaccttattcttccccttcttccggtccgaaatcgaaatcaaaatcaaatccgtcgcctgccgggtcagtaaactgttccagttcgcggcggtctttctttgtcgggcgacccatgcctctggcgcggtcaacaaagccggagatacgattcatttccagtatttcgtattggtccggagtcgttacattctccatatagtcgggaaccagcttggcacccatgcggcgctctgtcaatgccagcactttgaaagagaaggtgataggcggtttacgaacctgtatcacatcgcctacctttatcatacgcgatgcttttacatttacgcctccaatcattacccggttctttttacaggcttcgactgcaatggtccgggatttaaagatgcggacagcccacatccatttatctattcgtacttcgttcataactttttctgttgacaattcagttgaccgatgacaagcgacagttaattgatgataggagtgtggagccttatctgtcaactgtcacttgtcaactgtcaactatttattattgtattggttcatagtgttctgtacaccagccaggcaaaagcttttaatgatctctgctgcacgtttcattttttcgggcataatctccaactcttcgggtgggaatttccccagtacatagtcgatctgtcctccgcgggggaagtcgcttcctataccgaaacgcagacgacaatattcctgtgtgccgagaagctgctgtatattctttaatccattgtgaccggcatcgcttcctttgggcttcaaacgtaaagtaccgaaggggagagccaagtcatctactactaccaacaggttttcgacaggaatgttctctttttgtaaccagtaacggactgcgttaccgctcaggttcatgaacgtattcggtttgagcagtatcagttcacagttttttacccgcatccgggcaatcgctccatagcgttgttccgtaaaggggacgccggcttcttcggccagggcatttacgacacggaaaccgatattgtgacgtgtcccccaatattcagggccgatattaccgagtccggttatcagatatttcataattcttacatttataataataaagggaagaacattcagctgaatatccttcccttttattttgttattaaagccggaccttcctgggaacgaccggaaactttaattgactaattagttcgctttagcctgagcaccacgagcggcacgagtcaactgaacggcgcaaacaacagcgttctttgcattcatcagttccagaccttcgaagtgtaaagcacctacctgcatagatttacctaagcccaggtgatcaacgttgatagtcagtttttcagggatctgagtgtaaacagcttttactttcagctttctcatacgcaatgtcagcttaccaccggctttaacaccttcagcgtgaccagtcagaacaactggaacttccatagctaccggtttgttttctgaaacttccatgaagtccatgtgtatgattgcgtcagttacaggctggaactggatgtctttaacaacagccatagtttttgttccgtcgatgttcagttctacagcgaaaatttccggagaataaaccaacttacgtacactatcagttgtgattgtgaagtgagttactttttcgccaccgtataatacagcagggatttcctgatttttacgcaaagctttcaaagctcttttctgatcggcagaagtagcagctacttctcttccttttccttctaattggaatgtcttcattttcttaattttttgtgttactcaaaattagtttttatgcttcctaatttcccatcacacgtacgggggttaaaagcggtgcaaaggtatgttttttatcaatatgttccaactgtcccctgtatattttttttatccagtaaattatgggagcggagcaatgcttctgtatcgtcccagagtttactttgtgccggatgattcaggatatgttccgacagttttttctctttgcagttggcatagcagcagccgcttttgccattcacatcttccgacaaggcaaggtgtatggctgttgccgctccttgcagcggggttttgatgaaagggcggaacagaatatctgtcagcgggtcgaaccaggcattcatcgtgatcatatttgtactaacgataccgggattggaggcattgacggtgattcctttttcttttaccctttttgccagttcgcgcgtaaagagtaataaggccagtttcgtatttccgtacaccgatatccggttgaaacgtccgttcttccctttggtgaaaaagtcggattctattttaccgatggcgtaggtgcaggataccgtattgacgatgcgggttccttcatgcatcaggggaagcaacaatcgggtaagtaggtagggaccgacataattcacactgacgatcgtttccaatccgtctatcgttgggcggatgtcagtggtcaggactccggcattattcattaaccggctgaccgggcggccttccgccaatattttttgtgcgaaagtataaacggatgataaagaggagaggtctatcccacggacctctatttgttcatttccactttctctttttatacgttcgcaaaccgggcgtgctttctctggttccttgcacgccatgatgatctgaaaaccgtctttagccagtgccagggtaatctcttgtcccatgccaccgtcggcaccggttataatggctattcctttttccattattatttatactccagtttttctatttctttgacaatacttttaggtagattctgcatatgtttatggcaagccatttccagcgaatacatgcgggcaatgcagtagttactgtgtccgcaatcgcaacgggcctgctcgtcttctttcatacggttgacgaatgccggatcgttcaggagtgcacgtgccatactgacaaactcgaacccttttcccaatacttcatctatcttttcccgtgagataagaccgccgacatatacaagaggcattttcagggctgcccggaacttgagagcatcttccaggaaataggcctctttgaacggttcggtcggtatcatcaggtgaccggccattcttacgccgaggggtaaccaaccggccggcatataatgtgtcattgtgcggataggcatggctccccgcatgacgtacatcggggcacggcttacaaatccaccgctgagtatcagggcatgtacgccgcattcgttttgcagggtacgggccacttccagtgtctcgtcgatttccatcccgcctttgaagccgtcacgcatattcgttttaaccaggactgccatatcggaaccggccgccttcattacttcctccatacacatcttcataaagcgcatccggttttccagacttccgccgtattcgtctttccggtgattggtataaggcgaaaggaactggctgatcaggtagccgtgtccggcatgtacttctactgcgtccattccggcttcgcgtgccagatgaacggcctgcccgaatgctttggccatcgcggctatctccgattgtttcatacccctgacaaaagtaggtgagtagagattgaagccgctcgatgcagaaataggggtacatccgcaaatattcttatgagacatgtttccgcaatgtccgatctgtatggatgcggcagccccttctttatggattgcatcggttatctttttcagtcccgggatgatatcgggacgtagccacaactggcgctcgaaagaaagtccgctctgtgtaacggctgcataagcgagtgtcgtcataccaatccctccggcagcaacagaggtatggtaattatacagcatttccgacggggcgtttcccgggcacatactttcgaaggcagccgcacgtatcgtacggtttctgagtgttaacgggccaatcgtggcgggggtgaatagtagagattctttgttcattgtataatcagtatataaatggaatgatccgttttctgtttcctacttcctttccgaacatggttttgtatttgtgccagatggtattggcacgaggcacgaggttcgcgaatgtccaccaggcgaacaaggcaccgctggcactccaagtcaggatcgcaaaaccacaccactctaccaactctccgaaataattggctgaggtgacgtagttgaacatacctcccttcggaagatagtggttggtgtcgcccggtttacgcaggtgacgaacgatatagtcggaacgccagttgatatacatacctgtaaagaaaaggattgttccgataataaattgaggagtgcataaccaatcgattgaatacatactttcgggagagaggtaaaatatccacatgccctgtatatatccgttcagcaggttgaatacgatacccatggtcatgatcccggccggcatcttactttttcctttgatcaatagagggaagatgaatgcccgctgtaagtaatgcagttcaaagaagaggaagaagagtaggggaactgtttcaaattgtcgtccggactggctccataatagaagcatgaccaggaaaaccggagcttccatacatatccaggcgatcttgttggagatgggcttcccccatttcttatcgaacaacatgccgtatccggcttctacaaaatagagggtgatgaaaacaatagcggcaatcactgccattgctattagtaatatattgaaatattcgtttgtcatgcctgtgtagctttagtcattagtttgtatccttttccatgtacgttctcgatcctgatagtcgggtcggcttttagcaggtgacgtagtttggtgatatatacatccatactgcgtgcattgaaataactgtcgtttttccatatcctttgtagtgcggaacttctgtcgaccagtttgttcgggttctgacacaatactttgagaaggtccgactctttggtggtcagtttcttctcttcttctcctatggataacgtttgtgtatgtgtgttgaaggagaaaaggccgaatttgtatataacgatcggtttttgctgatcggagacagatcgtttcattattgcatggatgcgggcctgcaatacttccaggctaataggtttccgcatcagatcgtctgctcctatctggtagacttctacgatatcttctttggtcggagaattgaataagaagatcagtcgtgtttcattccgtacggctttgaatgcagcagccagcgtgatttcttccttatcggcggatacatccatgatacaaaggtcggagccaacggtacaaaagaaatcgtaggcctcttcagcctgggaaaaagtttcagtgacatatttatcagtcttcagacattctttgaataatgttcccaggttttcgtctttagtaaaaataaggatcttaaggtgtttgtccattgtaaaaaagattctatgcttcttcatgagaagctttataaaggttatatctttcgaatacagcctgttttaattcttcgaaagtacaatccaacgcgcggttggaaatacaaataggtgatccgtagtattggagccttagctccatggaacgttttttactacgtgcgggttcacggtcaatatattcgttcggatttttgacctttaacacaatgtatttgcgtttcaggttgctaatatcgtccataactttgatattttcaacctctttccataaaatagtaccaaatctgtttccggtggatatgtcattaacaccttcttctgaaatatagatagctgtaaatttttcccgggtgaggtaataatagcttatgcaacaaaacaccgtagtcgacaacgagaaaaatccaaccaggagaaggaggaaacgtccttcgcccaacttcagctcgtgagagagtgtaagggagcctatgccgatcagggcagagaagagggttgtaaggaacaaccctctctgctttttcctgctcaatttaaatgttgttacagaaggtgtattcatgtgtatttaaattgttttttcaacattccatacaaacgcacgcaaaccttgtgcttccgtttgcatatccattttatgcaacagatcgaggaaataatctactttttcatcttctaccatagccagtatggcagagttcagagtaggccaggcgtgactaccgtaatgaggttcgccatttttgctgccacggccttgtacttcatcccaataggtgaagccacggatgttgttacgatccatgacgcttaagatcatttcgtaataggcttgattgaatgatatgaatatagctttcattgttctttctattttatgttataaccgggaactcagggttcccggtttctaagttttataattgttccagttggttcaacttggcgatcttacgacgacgacgtttcactccgttaccggcaaatacacaatatactaccggtacgataaccagcgtgatcaaggtggaaaccgaaaggccccaggctactgtcatacccatcgaacgccacatttcagcaccttcaccggttccgatagccatcggaatcatacccagtacggttgtcaatgtagtcatcaatacgggacggagacgagacttgccggctgttacggcagcagtaagaatactcataccacgttcgcggcacagaatggtgtagtcgatcaatacgataccgttcttaacaacgatacccatcaacatgatcacaccgatcaaggccattacccccagtggcgtttgcgtgatcgataatcccaggataacgcctgtaaaggcaaacgggatggagaacatgatcacgaacgggtcggtcaacgactcgaactgggcggccatcacgatgaacacgagaatgatgatcaataccatcaatactcccagatcctggaaggtatcctgctggtcttcgaatgtacctcccagctgccagctgacttcactcggaatatccatctttttcagttcgccacgtacggctgttaccaagtcgcttaaagcagcaccttgaccaacaacggcagaaacggtgatgatacgttcacggttcttacgttcgatggtaggcggtgtcatacgttctaccactttaccgacatcgcggatacgaactccctgtccggcattgttgtagagcatgatattctcgatatcttcgatagactggcggaactccggagcatagcgtaccttgatatcgtactcgtcaccgtcttcacgatatttggatgcggtagaaccgttaatacggttacgcaggaacaaagaagctgttgctacgttcagtccgttcatggccagtttctcgcggtcgaagtccacctggtattccgggatataatccttacggctgatatttacctgcgaacagcctttcaatgcttccaggcgttttgccagatcggcagctacggcgtcggtcttggcaaagtcgaaaccgtagatttcgatatccacggcattttcaccacccatggatccggactggcctccggccaatactttatactctttgatctccgagtaatcggccaggtcttcacgcatcatgtcacaaatttcgataagacctctttcacgatctccgacactgctcaggttgatgttcatttcgatgatgtgcgaaccgttatcgctcaactgtgcaaatgtattgtcggtatcagcctgtccttcggtgaagttcagtaccagaatttccggatatttttcgcggaactgtttgtctatacgtagagccagatcgcgtgttatttcctgacgggtaccgatcggtaattcgatagtaataccgatacgagcattatcctgagtcgggaagaactctgtttttacggtcggtatcagcagcatactaccaatgaacaccaatgcagcacctgtgataaccgttttacggtggcggacagcccaactcaggaaacgtgaataagcgacatccagtgcattcagtgctttttcgatcggagtgaagaacaatacatataaacggcctttcttcggatcgagacgtaacagctgagaacaaagcatcggggtcagtgtcaaagcacctacggtagatacgatcataatgatactaacgatccatcctaactgtttgaaaaggataccggccatacctgtaaccatagtcaacggcaggaatacagccaacatggtcagcgtagaagcgattacggaaatagccacctcattggttgcatgtactgccgcctgtttcggtttacttccccgctcaatatgcgtcgtgacgttttccaatacaacgatggcatcatccaccaccataccgattgctatggatagtgagctcagggagataatgttcaatgtatttcctgatgccagcaaataagcgaaggcggcgatcaatgagatcgggatagtcaggataataatgaatgtcgctctccagcgtcccaggaagataaatacaaccagcattacgacaatgaaggtgatcatgattgtttcctgcaagctgtcgatcgtattcaaaatgtttgtcgaggtatcgacaattacccccagttgtacatccgagggtaaactggcctgtatttccggaagcttttcgtgtaccttcttggctatgttaaccgagttggcaccggattgtttctggataacgatcatacctcccttaccaccattgttgaaggtttcctgggcacgttcttccacgtagtcttctacccgtgcaatgtcacgcaggtacacatttctgccgttgttgctgcctactaccaggtcgagcatctgtttggcatcggtaaactcaccctgtacacgcagggtgtaggtgttcgaaccgatatcgatactcccccccggggtgttacggttttcctgggcgatgaccgaagaaacgccttcaatagtcaggccgtaagcctccagtttgtaagggtcgcaatatacctgaacctcacggatcggtgctcctgagatagatactgcacctacgccactgatacgtgccagcgggttcgatactttatcgtccagtatcttatataaggcgttggtactttcctctgctgtcactgaaagcaacaggataggaatatcgtcggtaccaaacttaaagatgatcggattctccacatcatccggcagagacgactcaacgacatccagcttatcccggacatcgttggtcgcgacatcgatatcggttccgtattcaaattccagagtaacgatagagatgttttcgcgagactgtgatgtgatgtgcttcaggtcactcacactgttcaacacgttttccaatggcttggatacgttcatttcaatatctgtggcactggctccgggataggccgtcatgaccatgatcatattggtctcgatctccggcagcaagtctactgataatcgggttagggaaaaaagccccataattaccactgccacaaacacgagggcggtggttaccggctttttgaccgctgttgcatataaactcatatactgttatttcttacttgtcaatttctacttccattccattagtcaaacggttctgaccggttattaccacctggtctccgttctcaacgcctgatataatttcgtatttgttacccatacgacgtcccagttctaccttctggtaagatacttttccattcttgtatacataaatgtagcggtcgcctgatccggactgtttaacaatggcctgatcggggctgacaacgtgatttttggtaccgaagttcattgttgcacgggcaaacattcccggacgtacacgttcgtctgtatttgctatcttgatctcgacagggaaagtacggcttgttgcatcgatggtcgggtaaaccaggctcactttacctttgaatacttcgtcgccgtaaacatccagtttgatatctacttcattccctttctttacttgggtgaaataactttcggaaacattcacgaacagtttgaccggacgaatctgttcgacggtaaagatcggatttccaccgctatacatatcaccgttgtcataattacgggcagtcacgataccactgatcgggcttagtaactgggtgttctcctgcaggtttttgtaactttcacggcttatatccaactgggttttctgagcatcccaggctgatttggatgcaccgcccactttatatagttcgtcgatacgcttgaactccacttcctgattgtccaactggactttggcttgtttcaggttgttggcatccattttgaccaatagctggccttctttcacatggtcgcctacttctgcaaacagtttctcaatacggaccggcgactgaggtgctatattattctttatatttgcctccacagtggctgtaaattctgctatctggtctacatcctgagctgatacctgttctattttcactttcaccttttcatcaacggtctgggttgttgcgtctttcttctcacccgagcaggacatcagcaaggctaacgtaacgagtggtacaactttcagcatttcacgtgttttcatattgtaaactgtttttatttttattctcattgctagttaattagtaattttgttgacccagaactttctccagatctgatttagctaccatataatcgtatatggattgattgaaattcaacttcgattgcgtgagtgccaactcggcatcattcatttccaacagtgttccggcaccggtgtcatatcgcttttgggcgataagatatccgcggtttgcctgctccacccctttttgcgctgcatcgaacttcttgatgcaagtgttcatattatccatatattgtttgatagacagttgcaggttgcgttttgtgtcttcgcgctgtaagtccatctgttgcatggatacctgtgtctgtttgatcttatgatacttgcttcctcccgaaaagataggaacagtcagtgttacaccgatcattgaataagggttccattgatagtccctgaacttgaaattgttattcatggatgtccattgataaagaccggtcaaagacagtgtaggcagataatcgaatttctgcatcattaaggtcttctttagctgttcggcctgcaagtcgatctgtttcaaatccgtgttttcgcaaagtgtcgtgtcggtcgataagaaatctgcgaataattccgtttcataatcaaccagtgaaccttcacaatcgatctctatttccaggtccattcccagtaatgctttcagttgccatttggcaagtgttaatgaattcaatgcctgtagcatattgggttcgctgttttttacagttacatcggcacggatcaggtcgtattcggcaacggttccctgttcatatttcttcttgatatccaggtagttctccatcgcattgtcgtagctgtctttaaatacacggtatgaatcgtttgccagcaatacattataaaaacttttttttacctggttcaccatagatattttggatgaacgcgcttgttctaccgataattcgacatccaaggccgatatactcagacttttccataaagaggcattaaccaacggcatcgaagcgttaaatccgagactccagttgttatcgcgtccaacttcgatccctttactcatatccggaacttctgttccttcgggaacttccgtacttcccatatcgaagccgtccatatacataacctgttttttcagtgtcctattgtagtcggctgcaaaattaatctgggggaacagggcggcatatgaacccttttgtgcatactttttcttttcgatttctttgtctgcaacttttacggttgggttctcactcagcgcaatctccagcgctttactcaggttcagcttcaggacatcctgtgccttggctgaggtaaaggccagagatggtagcaacatcaaaactacccacatcatctttttcctaactaatactcgttccatttaaactagatttgattttgaatataatacctattataattctctcacaataaattctgtgattgtttcaatgcgtatctgtctaatattgcaagacctttttctgtacatatcccacgtaagaaagtaaataagacggtcttgtagacttccgatacagaatggttcaggaatgcacctgtggggcgtatcattttgatctgttcttttgccagcagggttacgatttcaaaatttatacctttctgaaagactccttcttttactcctctggaaaaaagcttcatacacttctttgaaaattccgctttattcttttcatttaattccagggccttcggatatcgtttcagatcatcatagaatttccggttataccatcggggacgcttcatgcattcttcataaaataagatgatctcttctacaacagaatagggaccttcttccagctcgatcaatacctgcttcatctttttgtgattgtattcgatacttttcaccagaagagtttccttatcttcgaagaactcataaattgtgcgctttgatatccccatgttacgggcaatatcatccatgctcacactttttattccgtgttgcgagaacaagtcaagcgcagtcatcattatctgttctttattcatatatattttttgtattctcgataattatgtacgttggcaaaggtctacttaatttagaaaaccgaaaaggtttattccgttacatgattggtttgaaacgaaatctcataggctttaaagaatctttatcggttgaaattatgtttgaattggtaaaaaatgaaacaaaaaatgttgcaggtataaataaaagcctatctttgcacttactacgattgagtaaataaagaaaattatggaaaatcttcctttaatagatttagcggagttgaataaaggtatcgttattcgtgatagctttcaggatattttttcaatagcggatatcgatggaacccgggatatagataattcagatgtacatgaatataccactccgatgcgtttggatgcgcttctgatggttttggcattagaaggctcgtcagaaatttatctggattatgtaccttatgtgttaaaagcaaacagtttcgtaattattatgcctacgcatacgatgcagttgaacaaagtcagtaaggattttaaagggaaactgttggttgtttcaaaatattttctggatgagtgcaatccggccaagcgtagtccttccatggcaaactatatgcaattgaagaagaatccctgcaccacatttgaaccggaggaaacggaattaataaacgaccagatagaattactgcggaagaaaataaagaaccgctctcatttcttccagaaagaggtgatgcaaaatgcttttgtcggttttctattggagatagccaatatcctgatgggtaaaaaagacggaatgctggtaccggccctttcacgtaaagaggaactttttgaacaattcctgcagttattgtttgaacattgcaaggaacagcacgtggtgactttttatgcagagaaactgtttatcacccctcagtatctgtcccttatcttaaaagaactgaccgggaaatctgcgaataagtggatcgacgatgctttgattgtggaagcgaagatcctgttgaaggctccgcaggcaaccgtacagcaagtcgcagatattctgcatttttccgatcagtcgacatttgggaaattctttaagaagcatatgggtatttctccgatggaatatcgtaagtcgtaaccttcggtttatctttggcggaacttgtaccagtttaataattctatgactccatagaaaatactggcgacgccaaagatgacaaatgtatttgctgctgctccaaacggataagcaatgatcatgatgccggtcagtaagataagtgccggcattacataaaagccgaacggcacgatactccacttacgtgccgaaaccagcataatgatttgctgaactccggctataaccagtaaagcccctagtatatacattaatatattcacaaaaaacgccggcataatcactagccatgcaccgaataaaatacttccggcaccgtcgatagggaacatcggtgaaggttctccctctactttctctcgcgtaaagtaactgagtaaagaaaagatcccgggtagtataaagcagatacctatggcgataaccagataggtgaccgcagcttccggccataaaaccagtacgaatcctaatatcatagcaaaagcactgcgcagaattgaattgtttacttttttcatctgaatatatttttagtagttcttttaatatataacaacgaaggtacggtattttctttgttaaatataacaggtataaagttataattaaaatgatttaatcttaacaactgtgctgattaatttgttttattagaaagggtaggaatcacgatcggaaacatttgtgatcagccgttgttataaatgaggttaaacattctattataaacgaatatgagcttgaaagaatcgtactggaagtattccctgattacaatcatcctggttatgggaataatactttttattgaatttatgccattcctgggagggatactcggagcattcaccatctatatattgctgagaaaacagatgctgcaccttacggaaaagaaacatctgaatcgcagcctggtcgctatacttctgctactcgaaaccattttatgttttctgatccctctttctctggctgtatggttgtttatcaataaattacagacgattaacctcgacccgaacgtactggtcagcagctttgagcatattgcagatattgtccgccagaaagtaggatacaatatattggataaaggtaatatcgcatcgatcgtctccgtactacccaagatcggacaggcattgatgggaggcatcagcggttttgctattaatatagccgtactggtattgatcctttactttatgctgatcggtggtagccagatggaagcttatatttacgacatcctgcctttcaacgaaaaaaataagaaagaagtcctgaaagagatcaatatgattgtaacatccaatgcgataggtattcctttgctggctattattcagggattgatcgccatgttgggctattggatatttaatgcgccgagtgctttcctcttcggatttctgacctgctttgcgactattattcctgttgtcggaaccgctattgtctggcttccccttgtcgtgtatatggcactgaccggagattgggtaaatgggttgggactagctgcttatgccctgatcgtgattacgaacgtagataatctgatccgttttatgttacagaagaaaatggcggatatacatcccttggttactattttcggtgtgattatcggtctgtccttattcggatttatgggagtgatcttcggaccgcttctgatctcggttttcatgctttgctttaatatgttcaagaaagaatatctgcatggaaagaatgacacaccgaccggttaatcctattcatattttttcctgatctcttaataaagcaaaaaaagagaacttccttatctatgttaccgatgggtaacttgcttttgtgaccagttggtaacaaagtgataacatatggaaaaagaagaagttatagtaagaccgagtaaaaacagggagttgacagagcttgccttgttgaatgctgtcaataccctgatagaggatgaggggttcgagaatttaggcgtcaatgtggtagcagccaaagccggagtttcaaagatgctgatctatcgttattttgactcgctggacggattgatcgctgcttatatccagaaatatgactactggatcaatctggagccggaacatctgggagattttataaaggagcttttccggaatcaaatcaggatgctccataatgattatacgccggttgacaaacaggccggagtcggaaatatcgatcatggcgactatcctttctgcttctatcagttacctggtattattggaagaaacctgtccgatatataacggcatcaagttacagtctaaagacggttgggaacaacttgagaatggcctggataaaataatagataactggataaataacgaaaaccatgaataaaacaactatcctggcaggtcttggagtcgttttttgaactttattaaactcattttctcttctgtaaaagaaaacaaacgtacctttgtttatctaaacgataaagataaagacgtatgagaagaagaaataattggcagatcatcaaaggtcagccactaacggaattcgataaaaagatactctatctccagaataaaggtcatttggttccttcccgaaaactgattaaaacagaagaacagatcgaaggcattcgtagaagcggagtcgtaaactcaggtatccttgatttggttgcaaaagagatcaaggcaggaatgtcgacagcccagatcgataagctggtgtacgattatacgatggatcacggtgccattccggctccgttgaactttgaaggttttccgaagagcgtatgtacttcgatcaatgaagtcgtttgtcatggtatccccagcgaaaaggagatactgaaggaaggtgatattatcaacgtagatgtatctaccatcctggacggttatttttccgatgcgtcccgtatgtttatgatcggtaaagtttctccggagaaagaaaagctggttcgtgtggcgaaggaatgtctggaagtcggcatgaaggctgccaggccttttggctatgtgggagatatcggacatgccgttcagaagcatgccgagaagaatggtttttcggtggttcgcgacttatgcggtcatggtgtcggattggaatttcatgaagagccggaagtggctcatttcggtcgtaagggaacggggatgcttttggttccaggcatggtttttaccatcgagccgatgatcaacatgggaacttatcgcgtttacatcgccgaagaggatggatggaccgtaataacagacgacgaacttccttctgcacagtgggaacatacctttgtgatgcgggaggacggcctggagatattatctgactgaatattgcagcaggttcagtctttttcattagctgaacctgccggctctttttacaccaatattatttatccgaacaattatccttgcatttgttgggctgtaaataatcccattcctgaagtttcccgtcaagcaggcgaagttgataaatgccattctgaaaatctggaaatccgagtgtttcccggtagccatcagccgtttgtttgacttccagtcttttataggtactccccataatgtttataatctccggtttgctcattcccagttctagtttctgaatgtttttatccgccgccagagcattggaataagtagctccgcaagaagttaatagacacatcgtaatcccaagtaatagtgtgtatttaattatattcatagtacgcttgtttttatccgttgatttttagctagtgataaactatgtgcaatatacgattataacttgatactaaccataggataactgatcttttataaaaaaaggcaacgcatccgatggatgtattgccttgtgcacggaaggagaggctcgaactcccgacacctggttttggagaccagtgctctaccaactgagctacttccgtattgcgggtgcaaaggtagctttttgtttttaatatgcaaggctttttgaagaaaagtgaaaataataattttcttgcatgataaaattcaaggaaaacagggtagtcgaagtttctttttctatctttggaaacgatagaattgatagttaaatctatactgtaaaacaatcaacgaagcatgaaaaacgaattagaaatgaactccaaccttctggttgagtttctgcaaaaaccttcttcccaatttacgaaagcggacattatttctttcatccgcgagaagggaatcaagatggtaaactttatgtatccggcaggcgatggccggttgaagacattgaattttgttataaataacgctgcctacctcgatgctattctaacctgtggcgaacgtgtggacggttcgagcctgttctctttcatcgaagccggtagcagtgacctgtatgtgattcctcgtttccgaacggcttttgtcgatccttttgccgaattaccgacagtcagtatgctctgctctttcttcaataaggatggggaaccgttggaaagttcaccggaatatactttgcataaagcaagtaaagcttttaccgaagtgaccggaatggagtttgaagccatgggtgaactggaatattatgtaatagcagaggaagaagaactgtttccggcaaccgaccaacgcggctatcatgaatccgggccttttgccaagttcaacgagttccgtacccaatgtatgcactatatctcacaggcaggaggacagatcaaatatggccattccgaagtcggtaattttaccttgaacgggaaaatatacgaacagaatgaaatagagttccttccgacaagggtggaagatgctgccgaccagcttgttattgccaaatgggttattcgtaacctggcttacagctatggattggatattacttttgctccgaagattacggtaggaaaggccggttccggtctgcatattcatatgcgcatcatgaaagaaggtcaaaaccagatgttgaaagacggggtattgtctgaaacagcccgtaaagcgattgcaggtatgatgcagctggcttctgccattactgctttcggaaatacgaatccgacttcttacttccgtttggttcctcaccaggaagctcctacgaatatctgttggggtgatcgtaaccgttccgtattggttcgtgtaccgctgggttgggctgcaaagaaagatatgtgttcactcgctaacccgttggaacaggatagccattacgacacggcacagaagcaaaccgtagagatgcgttcgccggatggttcggccgacctgtatcagctacttgccggattggcggttgcctgccgttatggttttgaaatagagaatgctctggagattgcagaaaagacgtatgtcaatgtcaatattcatcaggaagagaataaagaccgcttaagtacattagatcaattacccgacagttgtgccgcttcagccgaacgtttgcagaaacaacgggcaatctttgaaaagtacaatgtatttagtccgagtatgatcgacggcatcattaaaaagctgcaatcatataacgacttctctttgcgggatgacctgaagagcgatccggaaggaatgatccgcttggtgaatacgtattttcattgcggataatatagaaaaatgtgtgaaacatttttcagttgacagatgacagttgacaagtgacagttggaatttcgcattcggtaatcccatcgaccgaaagccgaaataactgtcacttgtcaactatcacctgaaataattctgtctatatgaaaggttacagcatgcctaatccttcaaacatgcctttatagacagctgctttttcttccaacggtttgggataagcccgggaagaagaaggcatacgatataatctgaatactctacctagtaaagtgaacgtagaataggaaccgaccttcggttcttcggtaggaggtaatacggataaaagtgtatccattgctttttggccggttacgacaatcgctttacactccggaatctgcgacaatacttcttccggatcgataggtttgataacttgcaggaagttgtcggaagcattgttcttcagacggatgatctcgacagccgtatcaccgatgccgatacctttttccttacaaaacagtttggctttttcttcactgaaagctttctttgtctccaggaaatactctttattattataaaataggagtcccaggatacgccacatatcgttctggatattcggatagtagaaattcatcgaccaacgttgcatgggaggtgggaagctgcccagcataagcagtttagtctgttcgggtagaaagaaccctagcggatgtaattctgataccattggcttctgttatttatctttttattgtctgttgttttttactgtgcatttcttcggcaaaagcatcgtatccgattgcttgtattcttctgatacaggctgcacgatccgaacggaaaagaacagagaaaacctttcctatgaagttgttgaacatcttacattcctcaatggaactgaccgtacagtccgcacaactcttatagttatgctcaatattgcaagaccgtattttgcaccatgcagcttttgcatttgccttgcatccggggcattgtttttttacaaatttacggcaggctccgcaatataatccacaggctgcaacatagtctgaactgggttgataggtaagattttccattcgaaaagtaaattaagatgattatttgtcttttacagagataccgatcataacggttgttccgtcgatattattccatacggaatggggaatacttccttttaccagaaacgactcgttggcattcagtatttttacttcgctgcccagctcgatacgtgcctgcccactggtcacaataaacagatggttatgttcgtgtgtatgcaatgaagtaggtccaccaccacctttttccagataagcaatggaaccgtcgataatttccccgcaatcagcaaatagcttctttgccaggaaatgaatatgatcgggaggggtgatgaactctttcataggactattttactaattcttcccattcaccgggtttaaaaccaaccagtacctgattttcgtttaccagtaatgggcgtttaatcaatttcccatcggatgccagcaattcaatctgttctttgtcgctcatggaaggcagtttgtctttcagttgcatcgctttatataccaggccgctggtattgaagaagcttttcaaaggaagcttactccgttcaatccattcagtcaactcttcaacagaagggttatggtcgattatatgacgatcatcataggataccttatgttcatcgagccacttttttgcgttccggcaagtactgcatttgggatattctaaaaaaagatatttcatatcattcaatctttatttgtctttcttgcgttggttctttgcatcttctttggcgagaaggacaacgttgtaaacaaaatcagtcatccattcttccgagtaaccgagtgtttctttgtatttacgaatactccaagccgttttttgtacgctaacctctttccattccgaacgggttacaatctcgtgaatcgttttggctgtctggttgtataacagcttttttaccaacatagagaaacggaacttccactgcatcaggttgtccaacaaagaaaacaggtcattgcagaaaccctgaaacagaaaaaagtacgatttgatatcgttttgtgatttacaattctttttaaccgatgcatcaatctctttaaagaaactttctttcatgccgtagtcttgcataaggatcttacgtgcacgtgatttttcggcaatacccggtttgttattttgtgttgggatcttcaacatccgtttgaatagcgccatatccgacagcatattgatgttggttatacccagttgtacagccattactgcctgataataaacgcggatcaaagaaacgaactcttcaacggaaccctttgaggtagcttctgtttcttctttttctttcttgaaaagtttagaaattatgttcatgtgtatttgttataaataattacggggacaaatatagtaaaacttgtccccgtttcagtaattctattcaattctctcgactgttatttccggaaattcttccataaacaggagtaatttgttgtcatccatgctttttttcgcttttatgactatcgtaacgacataagtgtcggcattcgaatgattgactttttccatttgataggagacgagcatataacctctgtcactcagtactcgggtaaccttttgtataatgtctttctcggcagttgaaaagatgatcatcgaacttctcatccccaggcttttaaagatgaaacttaatagctccagaccgattaaagtcaatattgtcgctgctacaccgacaccatacatcccggctccgatggccagtccaatcccggcggtagcccagatgcctgcggctgttgtcagtccgcgaacaaactgtttctgaataataatcgttcctgcaccgataaaaccgatgccacttaccacctgcgccgcaacacggctggggtcgagggaaacactgttttcctgtatgatttgttggaaaccatactgagaaacaatcatgatgagagcactacctaatgaaaccaggaaatgcgtacgatatccggcttcttttgccctgtattcccggtcgagaccaaccacagctcccagaagacctgcgataaataatctaagtatgaaatcccataacataattgtatcctccttttgtttataatcccagtactacgtgctggataatatagactccggcccctgccagatatccaaggagtgcaagtaacgaaatatttttgagataccaaatgaaattgatacgttccagccccataactacgactccggcggcagatccgatgatcagcatactgcctccaacaccggcacaataggctaagaattgccagaagatgccatcttgaacgaagtttgccatataaacaggatcggcagctgatgcaatcatagcttctgttgctaccggatacataccgattgcaccggcaaccaaaggaacattatcgacgatggctgataaggttccgataatcaggtttacagcgtatacattacctaccgtatcatccagccataaggcgaaattggagagtacgccactacaacgcaaggcgtctacagctaataaaattccaagaaagaataataaagtagctccgtctatccggcgaactatttttgataaacgaagttttatatcttcgtttacgatattccgcttatacattaattctgtatatacccacaaaatacccacacccatcaaaatacccatgaatggaggcagatgggtgattgtcttgaatataggtacgaatacaaggcagaaaacaccaagaattagtatcgaaagtttttctttatttttcagttctttgagcagttcatcattttcattgtaagtaaatgcatcgggaggtgttacctttccgtgcaggaagtgcatcatgatcaatacgggtactgctgctgaaaccaaactcggcaagataaggtgagggatggttgaggatgtagagatattacctcttacccataacatgatcgtagttacatcaccgataggagaccaggcgccaccactgttggctgcaataataatgacgctaccaaacacccaacgttctttgtagttgcctaataattttcgcatcaacataaccataacgattgaggttgtcaggttatcaagtatggcggacatgaaaaatgttatacaggcaactaataccagtaactttttcttctggtttgtcttaatgcggtttgtgatgaacatgaaccctccgtgggcatcgatcagttcaacagtaatcattgctccgatcaggaagattagtgtttctgcaatttcaccgatactatccaatacctgatgttcgacgacaaagcgggtactttgttccacgaaagggagagctgctatgcctggatgcgaatccaggaactctttaaaggcttcggcagaagcaattgggataagatcgggtgccccgaaggtatataaaacccaaagtatagttccggttagtagggccgttccggctttgtttactttcagtggatgctctaaagctatacatagatacccaactaaaaaaaccaaaatcatcactgttaacatagctgttttctctttttctttttaaatttagttaatagtcgcaaaagtaagaataatataggattaacactcatttttaatgaaatgttttcatcaatgaaaactattcctaaataaatacgaagatgggtaggaaagtatattgctttattatgtttccccattattttattagcactggggaactttccccatataagtggggaagagtccccggtgctgtgggctaaaatccccatataagtggggaaactccctttgtaatagggtaagttcttttactgtgtgagatgaaaaaataaaaggtattacccgtagaaggtaataccttaaatagaagtgagcggtaagcgagactcgaactcgtgacccttagcttgggaagctaatgctctaccaactgagctactaccgcgttagactatgcaaaagtatgtaaatcttttcttttttagtacctttggagcaaaaaatattttgtcagatatgaaaaaagaaaagcttacgctgattaaagtaggtggaaagattgtggaggaagaagaaacattacaaagtttgcttcgtgatttctctcagatagaaggatttaaggcgttggtacatggtggtggccgttctgctactaaactggctggccaattgggtatcgaaagcaagatggttaacggacgcagggtgacagatgctgaaacattgaaagtggttactatggtatatggcggtttggtcaataagaatattgttgcaggtctgcaggcattaaatgtaaacgcattagggttaaccggtgcagatatgaacctgatgcgttcgaataagcgtccggtagcagaggtggattatggttttgtgggagatgtaaaagaggtgaatgctgatctgttggcttctcttatccatcagggtattgtcccggtgttggctccgcttactcatgataaacaagggcatatgttgaataccaacgcagataccattgccggagaggcagctaaagcattggccaaacattttgatgtgacattggtattttgttttgaaaagaaaggcgtattgaaggatgaaaatgatgacgaaagcgttattccggaaattgatcgtacagctttcaagcaattggtagagcagggtattatacaaggaggtatgattcccaaactggaaaattcattccaggcgattgatgcaggagtcaaggaagtcattataacccaggcttctgaaattcatttaggcaaaggaacgaaggttttttaaaataaaaagaggaaagttgctacagactttcctcttttcttttttattacaagcttcttacttttacattgcggaaccagataagtgaatcaccatgttttccttgcagacctatataaccttttgtcggtaattcggcaaaaggtttgggtaaccaactgggaatttcgcttccatcaggatttactttgcctgaggtccatttgctcatatccatttctgttacttttttgccattcaaaataacagtgatgcgttgtccggcacattttatacgcatatggttccattctccaggcttttttacaactttatctttgttcgctcccaggtggccataaatggcaccacatttttcatagggttttccatttccccatttttcgcaatgatcgtcagcgatttgtatttctacagaattggggatccagtctttagtgtccgtacagtaaatgacaacgccactgtttgtgcctacatctgttttgaaatccagatccaactcaaaattttcatattcggttttggtccatattgattcgtcctgcacagctgcaagtacgccatttgtcatgctccagacctccgggttatagctggcatctgatagatttgctccaaatagaggctgccatttgtttttatcggctgcagaaacattgagtgtgctgataattcccagcaaaagaattgagaaataaaataatcgtttcatgttattggattttaagataaaataattagcaatcaaagatagataatctcttcaaaactataagatgaaatcttactaaattcaataaaactttttgattgatagtaaaacggtcgcttttgtgtaaaaaacaaaatattagattgttgttttgttttattttattatttttgtctcgtaaaggtgggtagtctatcagactgaattaagtggaatagaacgtaatacaataaatatattggattgaattttattaagttgagttgggaaattacaggcattataataactaatttgtaagaattttatagacataccacgcctgtatatatataagggattgctcgtgatgagtgatcccttcttctttcttgtcgatatatttaagttttataaagaaactgtttacctttgggcgtataaataaaagatgatgaaagggaataatacaatagttaacctgcagaatgtggttacccgtttaccagaactccgttttacagagccgtttagctggtcggtcaaggaaggggaacagtgggccataataggtccgaacggttcagggaaaacattgattgcggatatgatgcaacgtaagtttgcattgaaagagggagaaatcactttcggttatgaagataaagtaagtaatctagtcaagagcattgctttcaaagatatctattcgttggcggattgccggaatacatattatcagcaacgctggcattcgacggaaacagatgaggtgccgacaattgagcaaatcctggaagaatatgccggtacggagaatttacgtcaggtactttctttctttggtatagaagatttactacccaaacgcttgatctttttatccagcggcgaactacgtaaattcctgattgtccattctctcttgacacgccctcgcattcttatccttgataatccgtttataggtttggatgcttcttcaagagatgtcctggtcgacttgttaaatcaaatgacaaaattagaaaatgtacaggttattttgctcctatctaatccggatgatataccggaaatgataacacatattttacccgtacataaccggatggtttttccaccggaaacacgggctgagtttattgcacatacagatttgcttacccatctttttccggatcattcttcggatgttccattgccaatatcagaaaaggagccttccactcatgatgttactttccgtatggaacgtgtttctattaaatatggagccagaaccattctgaaagaactcgactgggaagtacgaaacggagaaaaatgggctttattcggtccgaatggggcaggaaagtcaactttgttgagtttaatttatgcagataatcctcagtcttatgcaaatacattatatttgtttgaccgaaagcgcggatcaggagagagtatctgggatataaaaaagcggataggctatgtttctcctgaaatgcatctttattatatggagaatgttccggtgttgaacattgtcggttccggatttttcgattcgatcggattatatcgtaaatgtactgcggagcaggaagcaatagctttggactggatgcgtgttttggggattgagacattaaaagaccgctctttcctgacattatcatcaggtgaacagaggttggcattactggctcgtgcattcgtaaaagatccggatttgattatattggatgaacctttacacggcctcgatatcagtaacaagaagagggcggcacggataatagagcagttctgttctcgtccgggtaaaacgttgatctatgtgacccattatccccatgagcttccgcaatctgtggataaacgttttgaattggtaaaacatgcttaaaccacaatatcatgaaattgaaagttgctgttttctggctggtcatattggtagctttattcgtatttctgcaaacatatagtaaatatcatttttactttatcgagcagacacatttgtttcagtttaccggggaatatatttcagggaagttgatcattcccggtgggttcgctttagttctgtctgagtttttagttcagttctttattcttccatatgccggagctgctattattgcaggattattgcttattaccggacttggggtaagaggtattgtacaccggattataccggatacgactttgtttctactctatcttattccggtggttttgattatgttcatccattttgattttaactatcttgttgccgggacggtagcactcgacataatgctattggccttatatttttgtttgcgtatctcgaatgataagtggcggatagtggtagaagtgttactttcgcctgttctttatggggcaataggatctgccgcttttttgttttccattttggtcgttatttatgagttgtttaataaaactcctaaatggtactgggtattgctttctggcgtgttggttgtcttttgtggtatttgtagtgtctattttgccgctttgggtgaatatcgttttgcttttctgcctgatgcctattatcatacggctttggaaccgaagtcggttatctattattcgtggatatcacttcctcttattttaattctatcgttttggttaaaacacaagcaaaagcgggtaagcaaaaagttcttgattgcaggttgcggtgtgcaagtcctgttgttattccttttgtgttggtggggagttcctgagtacggagataaaaaatctatcaaagtgaaggagttggactattatgccagaacggaacaatgggataaaatcattgaagaaagtaaaggaccgcttaccaattatctgaatttatgttatctgaatttagctttggcacataaaggagagttggcagacagggcattcagttttgaccaaaaaggaccgttaggattgatggttggctggaataaaacggagcagatatctattttgctgagtgaagttaattttgcaatgggaaattcggctctggcgcaggagatggcgtttgaagcatttgcaacgacaataggagagggtaatccgcgtatgttgaaaaggttggtgcagacaaatctgatttatggagagtatccggtggcggaaaaatatattaaagtattggaaaatacaggttgttacagctcttgggcaagcggacaacgtaagtttttatataatgatgctgaggtagaaaaagatacggccctgggatcgatgcgtaaaagtttgcccaaagataattatttgtcggaattgaataatatggagaaagatttacgggttattgccgaaactaatccgtcaaacaggaatgcaattgaatatctggggcttttttatttgatgtccaaggatatggccggctttaaggggatggtggagcattattatggtacggatgttttgcctgtattgcctaaatcgtttcaggaagcagtaatcaccttgtcggaggctgaacctgattactggaagcgttttaatatttctccttcggttgtgcaacgttttgtagaatataaaaaacaagttttggcaaataggagtaatgcgaatgtactgccagggttaatgcgaagagcctatggagatacttactggttttattttatgtttaaataatcggatgaatatgaagggtaattataaatatatcatgttgctggctatgtttatgtcctgttcggatgcggttcaggttagcgataagttaagtgaaaagcctgcaattagtccggattataccgatgttactattccggcgaatatcgctccgttaaacttttcattgacaactcaatatgaggaggcacgtgtgattttatcttcggctgaccggaaaattgaagttaaagccaaagggaatcagtttgtaattccttcttccaaatggaagaggcttttacagtctactgccggtaatgcggtagatgtaatcgttcaggcgaaagaaaaaggtaagtggatagaatatgctccttttaaattatatgtagcaacggaccctatcgatccttatattgcctatcgtttaattgctcctggatatactttgtggaataagatggggctttatcagcgtaatctggaaaactatacggaaacagccatcattgaaaataagatgagtggccggaattgtgtgaattgccattctttctgtatgcagaatccggataagatgcttttccatatgcgtgaaacgtatcctggaaccatactggttgacggagataaaatagaaaagttgaataccaaaacggaacaaaccgtttcttcattggtatatccctcctggcatccttcgggaaaatatgttgcattttctgtaaataatacaaagcagggattccatatgaacgacaggaaccggattgaagtatttgatgagacttcggatgtcgtagtgtatgatgtggaaaagcacgagatagtaactaccggaaagttattttcgaaggatgcttttgaaactttccccactttttctccggatggaaaaacactttatttctgtacggctggtgcacgttctattccgcaggagtattctgagatcaaatatagcttgtgttctatttctttcgatccggatacccggagtttcggttctgtagtcgatacattatataatgcaaatataaaaggacagagcgtttcttttccacgtgtttctccggatggaaactatttgatgtatacggtatcaggttatggtaatttttctatttggcataaagatgctgacttgtatatggcggatcttgcgacaggcgaaagcgtacctttagatatattgaatagtgatgatgtggaaagttatcattcctggagcagtaacagccgttgggttatattcagtagtcgtcggatagatggattatatacacggccgtatatcacctatatcggtaaggatggaaaagcctgcaaaccatttttattacctcagaaagatacagaattctatgatcagtttatgatgtcatataatattccggaatttatcaccggaaaggtgaaagtaggaggccgagtactgggactgaaagcaaaagaagatagaggaatagatgtgaagtttgccaaataaaaaaatacgatgatcatataagcgtttatatgatcatcgtatgtgggtttatacggttgccgtatgtgagtatatatggtgatcgtataaatagttatacgatcactgcattggattttgtttatcggctaccgcctgcccaccaaacgttttctgtaaatacatattggccattgccatatgcactttctacattcgggttagagcttacttcgtcactaccgtaaggtgcgcgtaacgggaatttacccgggttttcaaaactgtaaatgtcattgccttccgctttcaaacggcgtacatcattatagcattctgttgattcaccgttagctccccagaaagcaagatatttttgaatcattgtttctttcaaaggattagcagcaaacaacggagcaacttccgtgtcaaagtagttttctgcttcagcggttgtcactgcactggttgaattggctttaacaggtattgaagcattgtctaacgcagaggttacacttacttccatgttcatcaaaccggctacaacggcattttttaatactgttttcgcttcatccaaacgattgagtcttaccaaagcttctgcttccaggaatttcacttcgtggaaactcattagcatagtaggagcagtagctgctatcaggaagatagaagtattgtaatactcctgttcctgttgaggcttaccgttaggagccatcatggataagaaatctttttcttctccggtcaactgtttacagtaaaagccttcagcatccagacttttatctgcaaagagtgcatcaacaaatgcacggtgaacacgcgggtcgttgcgtgcaataagcttttgtgtcaagcttgcacttgcggctgtatattcacgactattgaagaagtcatacaacgggttaagattggcaactccatcataaacattgaatgcagcttgctcattagcgttttgtgcagcgtttttacaacattccaaaacagtgtttaaagcagcagttttattttctgtcacatttaatgtatgcatagtataacgggctttcaagccataagccaatttcagccatttattagcatctcctttgaataatatatcctgagctccagcttttccggtagcgtgtgtatcacctttaggcagatcttcaatagcagcgtccagataagcaatgatagctgtgtaaatatctttttgcttgtctattaccggattcatgaattgaggtttaccattctctaatttagctaaagcagcctggctgaaaggagtgtctccaaaagcatcagctattaagcctgcattgatagcggcaaggacttctcccatcccctttgttgtgtagtttccgggttgagttccttcttcagagcatttatcaatgatgattcgtgcatttttcagtgagctatatgtatttccccagatattattaaatgtggaagatgcatatacttctgaaacacgtgtttctgcattgtataactgattgaaaatacctacttcattttcaacataggaagagaaataatgattaaaatctcctccgatattactaaatgcagtagaggtaatcgcgtctgtcaggataaatttagcatcaatattatgaggattgtcaatatcctgattgatcttgtccattttgtcttcggagcaggagaatagaactccggccactaaagcgacagatagatatgtcttaaatttattatatgtaattttcatattactcatgtttaaaatttgaatgtaaaaccaaaaccataactagagcttcccggcatagagaaacgttcaaatgcaccagccatgttgttgtttcctaatgtagcttccggatcaagacctggtaattgtgaccataggaggatattacgtgcaaacacatttgctgtaatatttaagtatgatttttccagaatcggatagctcaaagaaatttcacgcaatttgatgaatgagttgtcataaatactagcttcatcaatagcattcattgcattaaaatagtcataagcattctctccttttatcttgatgtcgtttggagaataagacccatctgcattttgttttacggcaggcttttcgaataagaattcagacatattgcgataatcggctgaacgctgagttacaccatagtaatcaagaactcctaatgtaccactatagatttgtcctccttgtttccagtctaatacagcagacaagcggaacttgtataattcgaatgtcgtgttgaagcccaaacggaaatcgggagcaactttaccaataacctgaggttctcctgcctgaggaagaccattttcgtctacaacgatctgtccgtcatcattacgtaaataaccggaaccgtagattacagggaatttatcaccgataccggcacgtacctgaggagttacgaagccacctaacataatgctgttaacgccttctgccagttcatcaacatagttgtcgattttcgagaagttgaaaccgaaatcccagtaaatgttctttttctcaatcggtttaattgtcaatgttatttcgtgtgagttcgtatgaattgcaccaccgttagttatcattgagctataacctgtagaagtagataaaggcacttcaaagatttggtcttttacattctgacgagaataagtatagttcaatgaaaccaaaccattcaagaatgttaagtctgcacctaattcgtacgattttgtattctgaggtttcaggctcgggtcatatatcttataatatggtatatatgatgttgttgaaccgaatggatactggataggagtacctgccgagaacccaccaccataactgggtgtataatagtagttatcgaagtattcgccagccataccaacttcagcataagaagctcgtatcttaccgaaagtaaggattttattctcttttaaaggagaaagctctgtgaaaatccagcctaaagaaacggaaggataagtaaatgaacgatttccgcgaggcattgaagatacaatgtcattacgaacagtagcattgaaatacaacatattattccatgataatgccaagtttgcaaagttaccaacagtacgttttttcgttgttctttgttctgcctggaaagtcgttgcgtttccgatatgattccatcccgggaagttaaaattgtaccccttgcctgtagtgactcttgtagatttatttacaagttcgttaccatataatacatttagatccagatccggcatgattttccagtcataatttaatgtaaacagggagttcatttctgtgatgtgatagctatcctgtcttgagtaacctgttgaataacttttatcaccatatccgtatacgtcagaatagatagtactataagcatctgcacctaattgatatttggctgttaatttatgatcttcgccaaagtttgtatcatactgtgcatatgtattaccaaagaaacgctgtgaacgttctgtaaaagagttattgtcgcaagcccaataagcattgttgaatgttgttggacgatagttattttgtgtataagggtcgccgtctatatgagaaggtataccgttgaagtcataactaggaggtgtaccgtagatagttgcaaccacgccttcgttacctgcactttgttttctgatctttgaagtgataaagttaccactgaaacctgttgtccaatgctcacttaaatttgctgtagcattcaatttcgcattataacggtccattcctgtcttaggtatgataccttcagaggtactgtttcctaaagagaatgaatagttccctttgtcaaatgcttgtgaaatgtttacattgttactccatgaaacacctgtgttgaagaagttttttgcattgtcgtaaccttgcggtacagcccatggatccaatccggcagcagcacgttgaggtacataatacataccttcgtgtttaccgtattgctgagtgtaagaattgtcaacattaccaccataatttgcatcatttgccaaatcagagatcttagggccccaagccaatgacgtactgggagagtaagctcctccgctaccttgggcatattccttttggaagtcaggaagggttgaaactttgtcgaacgataggtttgatgttagtgtaattgaaggcttcccttttttagcacctttcccgcttttagttgtaatgacaataacaccattggatgcacgcataccataaagtgctgatgctgcttgtcctttcaggatattgatactttcaatatcattcggatctaaatcgacagcacgattggcaaagtcggaaccagcaacactacccgtgtttcttttatctgtgtcaatatcggcagcagatgaaataggcataccatcgataacatacagtggtgtattatcgccagtgaaagaacggacaccacggattgtgatttgtgaagaggctcctggcataccggatgacggagtgatatcgactccagatactttaccttgcaatgcagaagaaatgcttgtacttgcagcacgtgttaagtcatccccttttacatcctgaacagcataacctaatgcttttttctctttcgagatccccattgccgtaacgacaatttcggaaaggttttgagtatcagatgctagtctgatatttacaaccggttgaacagaggcttcttggcttttcatacctacatacgaaattaccagagtctttgcagaacttggtacatccaaagagaacgcaccatcaaaatcagtcactgtaccgaccatcgtaccctttacgacaatcgatgcaccaataattggctcattatcatccgccgagataacagtacctgttaccttcgtcgtctgagcagtcgccaacccaatacctaaaattaggcaaaacaaaagataagtcaactttttcatagacacacttttttatttaacttataaataactaatttgcactatatttgtgaatactttgccaaaaacctattataaaacatacctgagagaccgcaaatgtaataataaatttattataacaacaaaaaactaataagtttttacaaaaaaaggactgttaattaacaaaatagcgactaatacgagcctttcgggagttaaaaagcggtctttttttaatgttttctgcaaagtcacaaattaaaattatctatttttaacccccattcgttttatgcttcagatcaagatttatttggcctgaaaaggtgtgggttccactctggtagaaaatgcaaacgttttttatcttttaattatggcaaaaaaaagaatcttcggttgaaatgtaaagcgaaaggaattcgtctcttattattttttaatagaaaaatctgtccagcgttctgttcattttctaaaattgagaagtaaatggagagttttctatttctgttttaattagataaaaaagtatataaaagataccaatatatatattcactcattttcttagaagcctttgcctttgaattttgatagattgacgcataaagaaccgagttctgcaaagactttggtgatatcatacgtaggtatggaaaatcaagagctccctgtatctcctattgttcatgtcagattgaaatccgatactcagaatcttgacgaagttgtcgttgtagggtatggaactcaacgtaaaaaagacgtaacaagctctattgcgaaagttggaggcgaaaccctcagtaacctggtggcatcctcatttgatacccagttggcaggacgtgccgccggggttcaagttaccactcctagcggggtgcttggtgcaggacctcaatttaaggttcgtggtatgagtaccatcagctccagctctcagcctctgttcattgtagatggtatgcctatcgctaccggagacaatggagatggtaaaaccggtctgggacagttgtatgcttcgttcaatgcgatgtcggatataaacccgaacgatattgaatctgttgaaatattgaaagacggtgctgctacagctatttatggttcgcgtgcagccaatggcgttgttttgattactactaaaaaaggaacaaagggacgtgctaaagtgacctatgacggatatgtaagtgcagccagtgcagctaaattacatgaccttttaggtgcaaaagattttgtcatgatcgccaacgaaaaatttgaaaactgggatgagaaaggacaagcggtttataatgcttcagatcctgatacaaaatggaacgattatatattccagaccggttttcagcataatcacaacgttgcagccagcggtggtacagacaaaagccagtattatgtatctttcggatttacagaacaggaaggtattgtccgttcaaatgatatgaatcgtctgactttgaaagccgacttgacccagcaggcgacaaaatggttacgcattggtttgaatgggcagatgagccgtacaaaactgaatggtatatcgaattctgaaaactcactggggggtgttggttttgccggagtccgtatgcttccgaatgttgccgttttcgatgcgaccgatccgaccggatataatattgataaggaaagtcgtaaaacattgggacgtggtaataacctttcttatatagataatggtattcaaaacattatctgggcattggataataatgtgaaccgctctaccaatacacgtaccatcggtggtggttgggctgaaatcactattatggacggacttacactaaaaactcagggaggtctcgatatctctaacgtaaaagactttatgtattgggactctgaatcaggtgacgggtacggacgtaaaggtttgctcgaagaagtaaatacaacttacgaaaactggaactggcagaatatcctgaatttcaatcgttcatttaatgatgtacataatttaagcgcaactgctgttcaggaatacactcacagtgagtatgaatatacagatgctgctgttcagcagttgtctgacaggttctttacagaccatattatctccaatacttttggtataaaagatatcggcggatacaaaacatttaacggacttgcttcttatatgttccgcgcaaactataattatgatagtaagtattatgcaggtgcatctatccgttacgacggattatccagcttaccggaagatactcgttggggtacattctggggagcttccgttgcatggcgtttatctcgtgagaatttctggaaagacgctcaggtgaacgaatggttcaacgatttgcgtatccgcgccagctacgctacattaggtaattccgatctgggtaataacttcccatatctgggaacttatggtgcaaaactgtacggatcgcaatccggtattgcctggaaccgtatgggtaataacaacctgaaatgggaaacgactgaaacgttcgacttgggtctggatggttctttcttcaacaaccgtctgacatttgagttggcttattggcaaaagaattcaaaagaccttgtattggaagttccgactcctccgacaatgggtattccttacaactcatattacgataatatcggtaaaatcaaaaactccggatttgagttgaccgtaagcggtacagttatctcaacgaaagactggaactggcgttcagagttgaacttctctactgtaaaaaacacggttaagtcattgtatagcggaaatgatattgttgataattacacaattatccgcgaaggtgaatcttatcgttcgctatacggatacgactattacggtgtcaatatggaaaacggtaaccctatctggagaaaagctgatggcagcctggttcagttcgatacattcggttcgtatgactatgttgaatatgatccgtccaatgctaaagacgtatccaaaccatcctctttaggatccagcgaccgtaaaatattaggttcatccatgcctacctggtatggtggatggaacaatacaattacctataaagatttcgatttgaatatattccttcgtttctccggtggtaataaaatcatgaatgcctctcgccaaagtgctctgatgaatatggaatttgccaataatggtaaggaaattttaggcagatgggtgtctcctacacaaacgggtgacggtatgactcctaaaatcggttatggagaccagtctgttttgttcaatgacggttttaccgattcgcactttgtagaaaaaggaaattacctgaaactctctaacctggctctgggatatactttgccgaaatctgttttatcggcaataaacataaccaagatccgtgtgtatgcacaggctcagaacttattcactatcacaggatactcaggtttggatccggaaactaacactcgtttaggcgtagactggaatggtatgcctcagcagcgttcgtttacttttggagcaaatgttacattctaagattataaaacagtagaaaaattacaattatgctaaatagaaaactatataaaaatatatcagttgtagcattgggcgcagcctttatttcgctacccctattcagtgcttgtgaaagcgatgtggtggatctgtctccggtcgataaattctccgatttgacagcttacggtactccggcacgatgtgagttatctatgatcggagcttatgatgcagcccagtgtggtatgtatattaactccactaatggttggcaacgtggttatccatttggggctgccagtatacaacaaggagaaatgagaggtgaagatatgaacctgacggccgtattttacgattacacctattcagcgacctacaatttgtctacagcgaataatgtcgctatgtgggaaacctcttttgaggctataaaccgttataatacagtgtatgcaggtcaggaatatgccggtagcaatggtatactcgatgaagcgacagccaatcaatataaaggcgaatgtctgtttttgcgtgccttgacataccataatttaatgattcattatgcacttccttacaatgtggatggtaataataattatggtatgcccctttatactacggcaattaatacaccggaagctattcaggaagcattacagattggccgttcgacagttgccgaaacatatgcgcaaatccttaaagatctggatgatgcagaacgattattgccggaggttgtcactgctggtaagatatcccgtgcatctaaaggggcagctattgctttaaagacccgtgtttacttgcatatgcggaattgggctaaagttatcgaagaagctgaaaaactggaaggcggacgtttccaactggaatcagacccggttaccccatttacttcaagtgccgataacaaagaatccgttttctcgatcgaaaatagtacggaagataatccggatgttaatggctctttaggtcagatgatgtcgggacgtgacggaggacgcgcaattataacgtcatctcctaccgtttataactccaaatactggacgaaagacgacaagcgtcgtaacttgttattatatcgtgaatccgacaaatattatttctgtgataaataccaggatccaacttctcaggatgcatgggctccgattctccgttattcagaagtgcttctgaatgaggcagaagctgcagcacgtagtaacaataagacattggctctcgaaaaattgaacgaagtgcgcgacagatcactggcaaatccggcacaggaaagttataaggcttcagatttcactgataccaaagccctgttagaagctattctttgggaacgtcgtattgaattccacggtgaaggtcgtcgttgggaagatattcatcgtctcgcaaatgatgatctattcccttccggtggtatccctgctaaaattgaatacaacaacagcaagggcgtaggtgcattcgttgtaaacggagaagtaaaatctgaatggtatagttccagcaaaaagtttattccttatactgataaacgttttatctggcctattccgttaaacgatattttaagaaatccgacattagcaaaacagcaaaatgctggctgggaataaaaggatttttcataaaaggagtgaaccctggtagtcatcttagacttggggttcactttttttcaggctatattaataatgttgaactacttttttatcggatatcaaaatgataatttaacattggtttgcagggagcatacgagctcctggttgagattgttttcatacaggccattctgcgtgagttttgaaatggcatatacactgagtgagtttgttatttctgtaaaaaaggaataaatatgtagacaaaacgagttttgtgttttcaaattatctatattggtgcatttttggcactttgttttatttattattttgtagcttccagggctgatgaggtgttgtttagcatataaaatcaatcttttaacaggctattttctcgaaatccggactcctttttgcgtaaatctcgctttaaacggatctcaatttcgtttaaacagaaattattttcgtttaaaacgaagttgaagtttgtttaaaacgaactttcgagattgtattttgaaatatttgtgttaaaatatgtgtgttctcattttctggaagaggatttatgcgtgatgtatgtgtttttgatttatcttatatagcatcaaaataacattgatatttgtgtataaaaatcaatatgttatttcaggcaagtgtttttccatttgtttgcggaaatacatgaactctatccttttgcttttttgtttccgtgcaattttcattagaattactcttttataaaggatgtaattaaatgatttgaaatagatcggtttcaaatttgttggttaggtttattatatttatctttgttttaatcaaaaatacagatgaatatgaatactccctttgtttatggtcgtatagcagataaggagaacttcacggacagagatcaggaagtgaagttacttactcaaaacttcaatagcctggttaataccgtcattatctctccccgtagatggggaaaaacatctttggtcaacaaaacggcgcaattattgctcagttcaagtaaagacttttatatctgtcaggttgatattttcaattgtcgcacagaagaagagttttatgtcgctttagcgaatgcgctcttgaaagtatcgacttctgcctgggaagaattcgtttccggagtgaaaaaatacctcggacggatggctcctataatttccatgtctgacaccagtcaaacttatgagttatcatttggtataaacttcaaggataacaagatgagttatgatgagatactggatttgccccaggtgatagcgaatgacacaggtaagaaaataattgtttgcattgatgaatttcagaatatcaacgaatatgaagactctttggctttccaacgaaaattgcgcgcccattggcagaagcaaacctctgtttgttattgcctctacggaagtaaaaggcatatgcttctggatatcttcaatgattatagtatgcctttttataagttcggtgatatattatttttacataaaataggcaggcttgattggataacgtttatatccaggcgttttaccgatacgggaaaagagatttctgaaaatttatgcgataaaatagctgctaaggtaaaagatcatccgtattatgtccaacagttgagccagcaagtttggttacgcacaaaaaagaaatgcaccgaagatataataaatgaggcgtttttaagtctgacaggccaactcagccttctttttgccaatattatagatacgttgacatctaaacaaatcaactttttattggctgtggcggaaggtgttgtcaatttctcatccaaagatgtacttactaaatataaattgggaacttctgcgaatataaagaatttgagaaaagctacattagaaaaagatctgatagatattttacccgggaatataacagaacttcaggatccggtttttgaatattggcttaaaaatatttatacaggctcgttaaaataatatcttttattcctttttcagggtagaatttgagtatttatttcaataatatttgaattctgccttttttattattgcaacattaaacgcctgattagcagtgttgtatatacggtgttttcttttgcttattaattaaaaatagaatcttatttgatcttaagcggctcacgaatagcattaactgcttgaataacagagaattagaaaatgcgtagttctgcaaagactctggtggtttcatacgtaggtatggaaactcaggagatctctgttaaaccccagattagagtgcttttacaaacctccagccaggcattggaggaagtgatggttgttgcctatggcactgctaaaaaagcctcttttacaggttctgcaaaagccgttaatgctgaagaaattgtatctggttcaaaagaatctctggataaagcattagcaggtaaattgacaggtgtacgtgtaactactactacaggtgatccaggttctcctggtgagatcaacattcgtggtgttgggtccatcagtgcgtcaaagtcgcctctgtatgtaatagatggcgttcctgttaaaaatgatagcgatatgagctattatggtaaaacatccagcatccttagttctttaaatccggatgacattgaaaacatgacagtgttgaaagatgctgctgctgcttctttgtatggatcacgtgccgctaacggtgtaattattattactactaaatccggtaaaaaaggaaaaacaaaagtttcctatacaggtgaagttggatggtctaatatggctgtaaaacagtttgttcctatgactgccagtcaaatactagaatacggcaaagaagcattgtcgaactattacattttgaatggagatgccaccaatcgtgatgaagcatacgctatcattgattcagaaggtgatatggcttctttctttaatgatccttccggtaagactgatactaattggagagatgaagtgtatcgcacagcattgactcaagatcatcaggttgcaattagcggcggagcggataagacacaattctatgtaggattcggctacaacaagtctgaaggtattgttattggaacagattttgaacgtttaacaggccgtttaaacttagatcatcaagtaaatgattggttgagttttggtgttaagcaatctatcgcttattctaaacaggctggtggtcgtgaccaaggtagccaagagcaagggattggaacatcgtctcctcttagtttggtattctcttccgatccgacagctccggtaaagaatcctgatggaagttataacgaaaatgccaattggggagcagcttccaatcctcatttaatgctgggtatcgatcaatggatcaaatccaaaacaatgcgtagtttgacaaatgcagatgttcaggtgaaactttctgataaagttactttcaaaagtattttaggttatgacttcatcgatacaaaacacttcgaatattggagtccgaacagtgtggatggtgaatctgttaaggggttaggctcacgttacaattatgaaaaccgtaatttgacaagttcttccactttgcgctatgcaaacttgtggaatgatgtacattcattcgatgtattgggcggatttgaagttgaaaatcaacagttgacaaacataatagctaccgctaaacaatactcgaccgataaattgcctgaattaggtaacggacagcctgataacgcttacagtaatgtatatgaatccggactagtttcttacctggcaactgcaaactacaattatgacaacagatattatttatctgccagttttcgtcgggatggttcttcccgtttaggtgctgataatcgttgggctaacttctggtctgtatcaggtgcttggagaatcaataaagacttcctgaaagataacgatctgttttctgatttgaaattacgtctctcttatggtacgaatggtaacttgcctagcgattattatgcaaacttagctttgtattcattcagttcaggatatggtccttcttctgctatctattgggatcaggccggaaatactaaattaggctgggaaaaatctcagaactttaatattggtttggattggaatatgtatcaacgcgtaaatctaacagttgaatattataataaaaagacaaccgatcttttatttaaagttcctacctctattgtaactggttttgaaaacaactggcaaaatttaggagaattaaaaaatagtggccttgaaatagaagtaaattcgcagaatattaaaaacaacgatttctcttgggatacgaacttcaacttgacttatcaaaaagtaaagatcaataagcttcctgacggcaaagacatccaatatggcgatggagaaatgtatttacatcgcgaaggagaatcaatgtatacgttctatctgccggaatggaaaggggttaacccggaaaccggattaggtgaattctggaaggatccggaagatcatagcaaaggcgtagttaattactactcagaagcagaaaaaggtattgtaggaaaagctgtacctgatgtaatcggaggtatgacgaatactttcaaatatcgtgattttgatttatcattcctgatcacttaccagtttggcggtgatatgtttgattatcctggatattttttccatcatgatggattaagactcggttcgtttaatgttgaaaacgatgtagccggcaattactggaaaaatccgggtgacgtagtcgattatcctaagcctatatatgccaatccatatcgttcagatcgtttctcaagcagaactattgtatcttctgataatatccgtatgcgtgagatcactttgggttataatattccggtatggaaaaatgtattcaacaacctgagagtctatttccgggcaaataatccgtttatgatctggtctaagtgtgatcgtgtagatcctgatgtgccattgaatggttatcgtcaaacagatacacctcctaccaaaagttttgtttttggtgttaatatcactttataatctaattaaaacagggaatgaatatgaaaaaaatatatttggttagtttagcatttatgctgttgggcacagcctgtgacgatgttttagagaaaacaccaggaacaagcctgccggtagatgaagctattacttccgtcgatgatttacaaaatgcagtaaatggtgtctatgcttatcaggcaacagaagtaggctcgtatggtgcggattttactttatttgccgatctgcgtggcggtgattttcaatctatatctactgtgaatcacgctggtcctatgtaccgttatcaactggataaaaaccattctttggtgttcagtttttataaggtattctatgtgtctctggcaagaattaacagtgttttagctgcttcggaaaatttagaaggagatattactaatcttcaaggggaattgtatgcaatgcgtgctttgtatcattttgatctggctcgactgtttgcaaagttaccgacaacaggagatatgaatgggttgggagtcgtattgtctgataatgtttttgaaaccagttatattggtgaaagagcgaccttgcaggctacttacgattttataatcagcgacttgaataaagcacttcctatgctgacaaaggataaggctcagggacatataaattattgggcagccttaggtatccgtgcacgtgcttatctgtatctgggtaaatatgctgaagcattgaatgattgtaaggaaataatagcatcttccccttataaactttattctatagatgaatatctttctgtttgggataaagaaggaacaaatgaagctatgtttgaaatactgacaacttccatttataatgctcaacgtaactctatcggttattatacacatgcaaaaggctatggagaatgtgcattcacagaaagttttaaagccgaatttgatgctcgtccaaatgatatcagaacacagcttattgcagaagagtctgataatggctatactggattctatccgcaaaaatataaagggcgtgacggacaaatttatgtgaacaatccaaaagtgattcgtttgtctgaagtttatcttattgctgcagaatgtgctttgaaagaaggtaatgccggagaagctgctcggtatattaatacgctccgtcagaatcgtatagccggttatgtagatgtgacttccgttacattggatgatatattaatggaaagacgtttagagctgtttacagaaggacatacttcctgggattattggagaaatggaaaatcagtaaataataagtttgcaggagaaatcaaagcagacgattatcgtacaattcttcctatgcctatgactgaaataaatgtatctggtggaaagttacaacaaaaccctaattattagccagactataatctataatatgaagagccgcttctttgaggagcggctttttttatgaatgtaattgagtgatacctacaatgaatttatgtaatttcataaactggaagatagtttagatgcttttaccaagtgctataaatggggaggattaaaagctaattatcccaaaatgattatacaatggatgagttagaaggaagttcgtatgaaggaattaaacaaattccaatacgaaagattttacgagaattcaagtagtttttctatattgcttgcgtggataaatgttaataattctgtttttgaggtagaaatttggtattttaaattgaatatcagattttaccttttttattagctttcaatattaatgtattgattatcagtattgtatatagaggtggattaaaattaaaagttaaattgaatattgttttctcaggtaatatatattttccctttaaatttaatctgctgattattagtatattatggaaagcgtagttctgcaaagactctggtaatttcgtatgtaggtatgaaaagccaggaggtggttataaaacctatggtagaagtggttttgaaaaccaattccgaattattagaagaagtagttgttactggttatggctcttttaaaaagtctactttcaccggagctgcttctacgatgacaacggaaaagttacaagatatcccaaccatggctatggaggataagctggcgggaactattccaggggttcaaattagttcatattccggtgcaccaggtgctacgacttcaattcgaatccgcggtatgggatcaatgaatgcaggaaatgatccattatatgttattgatggtactccggtacaatcgggcaatattagtgcttttaatactccgaaaacaggagatggctataatagtaccggtacaaatgtattggcaactttgaatacgaatgatattgaatctattactgtaatcaaggatgcggctgctgcttccctttatggctcacgtgctgcaaacggcgtaattgttattactactaaaagaggagcagcgggaaaaactcagtttaatttccgtagtgactggggattttctaatatggctataaattatcgtcctacacttaatggtgacgatcgtcgtgaaatgattaagttcggtttgaaaaattactacatggatgaggaaggaatgtctgctgcacaagcggaatcggcattactcgaggatcttgattattttgcaacaaaaccttcaaatggttggacagactggaaagatattttgtttaaaaatggtagtcatcaaaattacgaaattagtgctcagggaggaagtgaaaaaacgaaattctatacatctctggcttatggtaaacaagatggtattacggaacgctctggactggagcgtatgactggtaatgcaaatttgtctcatgaggcggggcgtataaaacttgaggcatcgaccttgttttcgcgtatacatcaaaatatgactaatgaaggaacgtcttttgcaagtccgatcatgaatgctttttggactgcatcaccttccacggtaccttataatgaagacggaacttttagttcgaacttccctttgacaggtggagcgaatcctgttgaaacaagtacatataattatgaccgcaatgatataacccgttcgttcaatacagttgctgcaactgttactatttgggacgaattaaaattgcgtgaaaagattgcctacgattatacttcttctgtggaatctgtatggtgggatccacgtagtaacgacggccgttcttccaatggtgtgtttcaacgttataatcggtcacttggaacattaaccacacaaactcagttgagttacattaaaacatttgctcagaagcataatgtagatgcactacttggttttgaaacagaagattatactgatttatgggtttatactcatggttctcagtatcctggttataagaatgaaatttctaatgcaggagaaacttcttcagatagcaatcgcgacaaatcacgtttaacatctttccttgggcgtgtaaactataattttgataataaatattatgcaggtgttagttttcgtcgtgatggcagctcccgtttagcaagaagcaaccgttggggaaatttctggtcggtctccggatcttggcgttttatgcaggaatcattcacggaatcaatcaaaaatgttttaactgatgggaaattgcgtttgtcatatggtgttaatggaacgcaacctgatgatttttatagctatatgactaatatgtatagggcaggtcaaatttataacggacagtctggtatggggatcatcggtatcggtaatccggatttgaaatgggagaaaaataaagcttttaatattggtctggatttgacattattggagcgtctgaattttacgtttgattattatacccgtaaaacaagtgatctattgatgaacaaacgtatttcatatatccccggttattatgatccgatcagttatgccccgacaactttacaaaatgttggatcattagaaaataaaggtgttgagtttagtttaacttctacaaatatgcaaacaccagatctggtttggacaactacatttaatatcggacataataagaataagctggctaaattagatggcattcaaacagaagaaatagacggtgctttgatacatcgtgtgggtgaatcgtattattcttattatatgtttgaatatgcaggagtggattcaaagactggaaatgagatgtattataagaatgacggaacaaacgaaacaacaacaaatgtttccgaagcacagaaagttatcgttggataccatgatccgaaagtagaagggggattgactaatttcctgaaatggaaatttatagatttaaacctgacattaacttattctttaggtggacaagctttggattatgcgacttggttgcatgataatggtggtgactatacaacgaatggtgctattccttcatattataaattggaaaatatgtggaagcaggaaggagataatgctaagttgcctaaatttaaatatggtaatacccgtgtactttcatcacgttggttaatgccaaccgactatcttcgtgttaagaatttgtcgttaggattttctgcacctaagacactcttatctaagagtggagtttctaaagccagaatctatttttctgcaaataacctgctaacttggaagtcaaaagatttgttggttgatccggagatgccggtggatggcttatgtacttttgaaatgccggctttgagaacatatacatttggcatcgaaataggtttttaatgattaaaaaaagatataagtatgaagaatataatatataaggcattggttggtgctacattggtagcgggcttatcgtcgtgtgtcaataactggctcgatgtagagccgggcaatcaggtagaggcaaatgaggctgtcactacaagtgctgacctttcttctgtacgtgctggtatgtatcagatgataaaaggaacttctagttttaatgattattatgctgctcgtatgttttattatggggaagtacgtggggatgacatgcaatctgataaatcaggaagccgttctcagttatgctataacatgacctattcaacagctgataatgctccggatatttggcagactccttatgtggttatcggacgtgcgaatcgaatcattgaagctgctgaaagtggattgttgactgataaggaggatgcagctgatattattgcacagtatgccgcagaggctaaagtggctcgcgcaatggcacactttgatttggttcgtgtttatggtaaaacctatacggctcccggtgctccggtttctttgggtgtaccattggttacttcagtgatggattctgaaattaaactaccgagaaatacagttgaagaggtctatacacaagttgttaaggatttgaatgatgcaattgattctaatgctttgtctgaaaaatccactcctggttatattaatttatgggctgctaaagctttattagtcagagtttacctgactcagggagaaaatcggaaagcattggatgttgctgaagatattattgagaactcaccttataaattgtggaaaaatgaagagtatgttgctgcttggagtaagatcagtggagttcatccgaatgaaatgatttttgagattgctataactggttctacagactggaccgaccgtgaaggaattgcatatttgtataatgaagacggatatgcagatatagtagctactaaaaagtttctggatttgctgaatgaagatccgaatgatgttcgtcatggtgtttttctggctccggcaactgctgactataagaagacttatggaacaaatactgtgttcctgaataaatatccggcagatgggttgagtgacttgcgttataataatgtaccgctacttcgcttgtccgaggtgtatctgaatggggcagaggcagcagcaaaattaggtaatcagaatgataaagcgacagaatatctggaagccattgtaaagcgtgctaatccggataataccgtacaaggtacaactattacggttgatagagtgttgttggaaagaagaaaagaattaattggtgaaggccatcgtttctttgattcaatgcgtaataacgagacggttgttcgctatacttctgcggaagacagaggttggcactcagcactgagagaagaggcacgtagctttagccgtgatttctataaggttttacttcctattccccaggatgaactaaatgcaaatccggcaatgaagggtcagcaaaatcccggatatggagaataatccagatgtagtattcaagtcatgtttctagcatgctgtaaataaatacccgataaagttctattaatctttatcgggtatttatatattgggggatctgttaaaatagtgtcggtctaattttgactttatctatcactaagcaacacttttttattttttttctttctatcactaaaaaaatgaatcttctatgtttcactttctgaaccaattacgttttttgtgaattttagttccctttttgggtagtctcttcttgttttttgttttttatgattggtaagtctcttttatctttgtaaccgaaaagaagagcagcagcaacagaatcggttgttttttaaggcaggtcggagtattcgccaaattttgtcggaactccggtaaatatgtgataacaaacttttagtttgtcttatacgaaagaaagaacttattgtcgttccttcgtgtttcattcagaaaataaaatatatatcatggaaaaagtaatttacaacttggtgtttaaccgtaagaaactgttaaactcagaagggaaagctttgattcaggtagaggcctatctgaacaagcagaagaagtatttttcaacaaaggtttatattaagccttatcagtgggacgcaaagagaaaagctgtaaagaatcatccaaatatggagtctctgaatcagtatctgtctaattttgttgcggaattagaacaactggagcttgaaatagtccatagtggcaaggaattttcattgaatgatctgaaagagaaacctgaggctggtcagacttctttttctctgtttatgctaaatgagattaaacagagtaatctgaaaccgtcaacgatgaaaaatcatttttcaacattgcaggttctttcatcttaccaggcggaagttagttttaacgacttaagttataattttctttgcgattttgagcatttcctgttggtacataagtatcaccggaatacgatcgccaaacatatgaaacatctgaaacgttatatcaatctggcgatcaataaagatttattcgatttgcatcggtatcctttccgtaaatacaagatcaaatatatggaaagtaaaagatctcatcttactccggaagagctggagcaattggagagtcttaacctaaaggggcgtcgtacacttcagcggactttggatatgtttctgtttagttgttatactggacttcgtttttcggatatagtaagtataacaagagaaaattttctttgcatagaagataaaatatggttgatctactcttctattaagactgatgtaaatgtacgtttacctttgtttttgttgtttgatggaaagtcgctaccgatttatgagcggtataagaataatccatggaccttgtttgatatgcctgcttcttcaaattcgaatgtgaataagcaacttcgccggatttgtaagatggctcatatagataagaaagtttcattccacacagccaggcatacgaatgctacattattattatataatggagcaaatataacaactgtgcagaaacttctggggcataaaagcgtacgaacaacagaaatatatagtaatattatggatatgacagttgtgcgtgacctttccagcctgacaggcattaaataattatacgaaaatggcattagggaacgtaggaaatgtattatgaatttttctgtgttctctaatgtgtgctgacaaaatgatacaatatgcctggtaatgtccaggtgtgtatgtggtgtgtcttgctttttgttataaaatactgctttcaaacattataattccttgatatttttacggtatttatgctttgaaaagtaaataaaatatccgacttttgtctgcatgatgagtcaacctttagcagaaagattacgtccaaagacgttggatgattatatcggacaaaaacaccttgtcggacaaggcgctgtattaaggaaaatgattgatgcaggacgtataccctcatttattctttggggacctccgggagtggggaagacgacgttggcacaaatcatttccaataaactggaagcccctttctatactttgagtgcgatcagttcgggggtgaaggatgtacgtgatgtaatagaaaaagcaaaaggaaatcgctttttcaataccgtatctccgattttatttattgatgaaatacatcgtttcagtaaatcccagcaggattctttgttgaatgctgtagaaacgggagttgtaacgttgattggagcaacaacggagaatccttcttttgaagttattcgtccgctattatccagatgtcaggtctatgttctgaagtcgctggataaaagcgatttgcttacattgttgaataaagcagtcaaagaagactttatactgaaggagaaagatatccagttgaaagaaacggatgccatgttgcgctattccggtggtgatgccagaaagcttctgaatatcctggagttggttgtctctgccgaagagacggataagatagaaataactgatgaaagggttgtagagcgtttgcaggagaatccggcagcttatgataaaggcggtgaaatgcattatgatataatttcagcttttatcaaatcgattcggggaagtgatcctgacggtgctatttactggctggcccgtatggtggcaggaggggaggatccggagtttatcgcccgtcggcttgtgatttcagcagccgaagatatcggcttggctaatccgaatgccctgttattggcaaatgcctgttttgatgctttgaagaaaatcggttggcctgaaggacggatcatcttagcggagacgactgtttatctggctagtagccctaaaagtaattcggcttatatggcaataaacgatgcgctggcattggtggaacgtaccggtaacctgcctgtcccgcttcatctgcgtaatgcaccgacagctttgatgaaagagctggattacggcaaagagtataaatatgctcatgattataaagataactttgttaaacaggagtatttgcctaaagaagtgcttaatcaacgtttctggaaagggcagaataatccggcggaacaaaaactggtcgagcaaatgagaaagctgtggggagaccggttttgataattgacaattaataattgaaaaaggaagaactactgtataaaagatgttagaaaagaggtaaatgttgctttttgctaataatttatactttttgatttcttcatttcaattaaattcgtacattagccgcctgttttaaaaaacacgttacttaaataatatataacattaaaaagaaattgatatgaagaagcacaatttttctgcaggaccttctattctgagcgaatacacgattaaaaatgcagcagcagctgttgaaaatttcgcaggtacagggttatcgattcttgaagtatctcatagaggtaaagaatttgttgcagtaaacgacgaagccagagcattgattaaagaacttctggatgttccggctggttacgaggttgtatttctgggcggtggtgccagcatgcagttctgtatggttcctttcaacttgctgaataagaaagcttcttatctggataccggaacatgggcctctaatgcgatcaaagaagctaagttgttcggagaagtagacgttgtcgcttcttcaaaagatgcaaactatacttttatcccgaaaggttatcaagtagctgaagattcggattatttccattttacatccaataatacgatctatggtacggaaatgcgttacgatccggatatgaaggttcgtttggtgtctgatatgtcttctgacattttctcccgtccgatcgatatctccaaatatgatattatttatgccggtgcccagaagaacctggctcctgcaggtgtaacattggctattgtacgtacggatgctttggggcatgtagatcgtgccatccctactatgttgaattacaatacgcacatcaagaaagattctatgtttaatacgcctcctgtattccctatttttgcagctctgcaaacattgaaatggtataaggaactgggcggtgtagctgctatcgaaaagatgaaccttgaaaaagcagctatcctttatgatgaaattgaccgtaataaattattcaaaggtactgccgctgtagaagaccgttctattatgaacgtttgcttcgtaatgaacgacgaatataaagaactggaagaagaattcagtaaattcgcctctgctgccggtatggtaggtattaaaggacaccgttcagtaggcggattccgtgcttctctttataacgcgatgcctaaggccagtgtggaagctttggttgctacaatgaaagaatttgaaaaacagcattaatcatgacaaaggtattagttgctacagataaacctttcgctgcgatagcagtgaaaggtatccgtgaagtggtggaagctgcaggttacgaactggctcttctggaaaagtatacggacaaagctcaattactggatgctgtaaaagatgcgaatgcagttattatccgcagtgatattatcgatgctcctgtgttggatgctgctaaagaactgaagattgttgttcgtgccggtgccggttacgataatgtagacctggctgctgctacggctcataatgtatgtgtaatgaatactccgggacagaattccaatgccgtggctgaacttgttttcggtatgctggtttatgctgtcagaaatttctataacggaacttccggtacagaactgatgggtaagaaactcggtatcctggcctatggtaatgtcggacgcaatgttgcccgcgttgccaaagggtttggtatggatgtatatgcttatgacgcattttgtccggcagaggtaattgaaaaagatggtgtcaaagcggttgcttctactgtcgacttgttcaaaacctgtcagattgtttctcttcatatcccggcaacggctgaaacaaaaggttctatcaattttgaattgatgaactctatgcctaaaggagctattgttatcaatacagcccgtaaagaggtgattgacgaagcaggtttgaccaagatgatggaagaacgtcctgactttaagtatattacagatattaagcctgctatcgatgcagacttggctgccaaatatccggatcgttactttgctactcctaaaaagatgggtgcacagactgccgaagcaaatatcaatgccggtattgctgctgcaaaacaaatcgtggatttcattcagaatggtaacgagaagttcagagttaataaataaatccgcaacattatggcaaagataaaaccttttaaaggcatccgtccgccgaaagatttaataaaagaagtcgcttcgcgcccttatgatgtgttgaattctgaagaagcacgcgaagaagcaaaaggaaacgaaaagtcattatatcatattattaagccggaaatagattttccggtaggaacagacgaacatgatccggctgtttatgaaaaggctgctgaaaacttccggttgtttcaggagaaaggctggttggttcaggatcagaaggaacaatattatgtatatgcacagactatgaacggacgtacacagtatggtctggttgtatgtgcttatgtcgatgattatctgcgaggtaacatcaaaaaacatgaattgacccgtcgtgataaagaagaagaccgtatgaagcatgttcgtgtgaacaatgccaatatcgaaccggtattttttgcttatcctgacaatcccgaactggatgctatcgtaaagaaatatacggcgaatgctccggaatatgatttcgtggcagagttggatggatttggccatactttctggatcattgacgaagataaagatattgctcgtatcaccgagttatttgaagcgatgccctcattgtatatagctgacggtcatcaccgttcggcagcggcagctttggtaggagcggagaaggcgaagcaaaatccgaaccatcgtggagatgaagaatataactacttcatggctgtttgttttccggctaatcagttgactattatcgactataaccgtgttgtcaaagacctgaacggacttacggaagaagagtttttagcaaaaatagctacaaactttatagtagaagataaaggtatggatatctataaaccggcaggtttacacaatttttccctttatttgggagataaatggtattctctgacagctaaaccgggaacatacaacgacaatgatccgatcggtgtgcttgacgttacaatctcttctaatctgattctggatgaagtgctgggtattaaagacctgcgctctgataaacgaattgactttgtaggtggtatccgtggcttgggcgaattgaaacgtcgtgtagacagcggagaaatgaaggttgccttggctctctatcccgttactatgaaacaattgatggatatagccgataccggtaatatcatgcctcctaagacaacctggttcgaacccaaactacgttcgggactggttattcataaattggtataagaataggtaatttatattttataaatagaaatgcggatatgcaggaaatagctgacatatccgctttcttttatttctttatcctttcggtcactttggttccagtggctgtcgctgttccttgcagttctacatattcaacacctagcggattgctcggtttggttttgacatagagcgattcgagttttgcctgttggttgtcgatagtagccagacaaatatacttgccatccttcttgcaaatagtcagtactttagcgggataagcacttaatgtgacttctgctgaatcgtcttctgtcgatacaagtttatatccgtaagccatcttacgttggaaataacttaatccgttggtttctcccggacgttcttcgcggttcacccaatagacattaagtggtgatttgatatttagtctgccgttctccagattaatatcatagcacactaagtttttattggtactgcgagcgatatgaaaaagcctttctgcagttggataggtgtcttcatccggattggcagcagaaacagatgcagatatcatcaggcaacaggataggagaattataagtatatgtttcatatgttttatgatgttatatctttatttgggatgatagataatccagatattccctgatacttttttcatcatccggttccggactccacggggccatgttttccggacttaaaggtgcgaagggacccggttttacttcataaacgactgtgcccgactccagaacaagcaggcaatgccatatacccggagcgatctccgcaccgtatgatccggccttcggatcgagtagcagcttttcggtaatatttcccttttcgtcaaaaaggaaaagcatcgctttgccacggagaagcaggaatatttcatccttattagggttgagatgacgatgcgggcgaatataggtttccggttccattgcgtttaacagtcggttgaccggatcgtccagtttttcatgaaaattgtaattcatgcgcagccggggtgattgttttgctctggctgttgtttcgtcaagtagctgttcattaattattttcatgtcgtaaaagttttattttgagctacgaatgtacaaaataaatcttggttgttctactgataatccttacatttgcgcagaacctaaaaatcaacatatacatgaggtcttttattcatcgtttctgttttgtgatctttcttctctccctggttttatcttgtaagcgggaagaaaaggaaaagacttatgttgtaggagtctcacaatgttttagcaacgacccctggcaaaaggctatgttactggatttgcaggtgaaagcctctgattatcccaacctgaaattaaaaataaaagatgctgcagaagataatgagaggcagattgccgatattcagaagtttatcaaacaaaaggtagatcttctcattatatcccccaatgaatccaaacctctgacaccggttgccgttgaagcatttcgggccggaatacccacaattatcatcgaccggaagattgaatcggatgaatacacagcgtttattggagcggataattatgaaatcggacgctctgctgccttgtttgtaaattcattactgaaagaaaagacaacaattgttgaagtgtggggaaggaaaggctcttcttctgcccgcgaacgtcaccagggatttgtcgatgcattgatagggaatgatgttattaccgtgaaagaggtgatgggtgggtggcataatgaagaaacaaaaacaaatattgcggccctgggttcgtttaacgatatcgatatcgtttatgctcataacgatctgatggccatggctgcccgggaagtaattatgacgaaagacccgaaggcaggagaaaggatcaagtttatcggtatagatgcattaccgggcgtggggcatggaatagaagctgtcaggaatggatatttaacggcttcgttcctgtatccgacgggaggaagtacggcaatcaaagtggcctggcagatattgaccggtcaattcgtgtctaagaaatacgctctgacgtctgccctgattgataaggggaatgccggaaccatgtatctgcaatctgaacagttgactaactatcaggaacaaatcgagaaacaacgtaataacctggatgagatcttttcacaataccgtttcctgcaaaactcggtagcaatgatcctcttgttgatgggattattgattctgcttgccttgtatgtggtacatatcaacagaaaggtacaaagaaaaaatcatgaactgaaacaaacgaatatccaggtcgaacatcaaaaggaggaactggctatagccaatcgtaagattgaacaggcaacagcccggaaacttcaatttttcacgaatgtgtcccacgaaataaaaacaccgttaactcttattttggggccactgaataaattgtcgaaagaactgccggagaactcgccattaaccgatgatatccatattatcaggaagaatgcagaacgattgaagcgtgtagtcaatcaattgcttgacttccgtaaggtggagagtaataaaatgaatatgcatgttacgcaagtcgaactggtaacctttgttgaagaggtaaagtcctattttgagaatatggcacagagtaaacagattaactattctttttaccatgatatgccttctgtacttctttgggtggatacggataaaatggagaagatattggctaacctgttgtcaaatgcttttaagtttacgccggatgggggaactgtaaccatccgtctgcaggaccatgcaggttatgtgattttgtctgtggaagataatggaaaagggattcctcctgaaaacctttcttccgtatttgaacaattctttaccggcgatcagaattatataaccggaacaggtataggtcttcatcttaccaatgaatttgtcagtatgcataaaggacatatcgaggtacaaagtacacctggtaagctgacagtctttaccgtcgaactcctcaaaggcaaatctcactttgatgaaacctgtacatttgctccttccgtgactgaactgtccagtggagtagccaatctggatacgaaagagatggaggagattgtaaagcgaacttacgattatactattcttattgctgaggatgatcctgatattggcgcatacttacagaaagaactgaaacagaacttccgtattttattggtcgaaaatgggataaaggcttgggaaatattacaaagagaagatgtttctatggttatgagcgatatcatgatgccggaaatgaatggatatgagttatgtaagaagataaaatcagatatcgcattcagtcatattcctgtaatcctgcttactgccctgtctgacgataaacagcgtatgtatgggatagccagtggggcggatgaatatatccagaagcctttcaatatggaagaagttaaattgcgtatcgttaagcggctggaagaacgggcacgcttacgggatatacttgcgcaggaatttcaatcgtccggttcttcggatatgaaattcgggaaggtggaaagtatggatgaattattcatgagtaagttcctgaaactgatagaagagtcatatgcagactcagacttcagtatagagaaagctagcgagatgatcgggctttcccgggtacacctctaccggaaagtaaaggaactggccggagtaacacctactgactttttacggaattatcggttgaagcgggctgccgccttgttgcaacaaaaggcatataatgtgaatgaagtagcctatgctaccggtttcgcttctccggcatacttttccaaatgctttaaagccctgtataatattacacctaccgaatatctgggaaaagaataactctcgttacatctatgtaacatctgtgtattgctgtcgatactaaatttattatgtaacgattgttatcgatcttgtagcatatgttattgccggtgcttgttccttcttttagttttgcatcatcaaaagttagaaagcaatttgaacaaggaatatctgcacaatggaacaaatgaagcaacaaaatagaaagccggttgtagtcggtataggtgaactcctttgggatttacttcctacaggaaagactgcaggcggtgcaccgatcaattttgtttaccatgcttcccgtctgggggcggagggatatgctatcagtgccattggtgatgatgataacgggcgtgagatattgaacgaactggataaaaattccatccagtatctgatagataaagtaccttatcctaccgggacagttaatgtcgaattgaaagaggacgggattcccgaatatacgattaccgaaagggttgcatgggatcatatgtcgcctacatcggttgctgtcgatctggcagaacgtgtagatgctatctgtttcgggacattaggacagcgttccttacaatcgcgtgatgctattcaggcaattctttcttttgctccggatacggcttatcgtttgtttgatattaatttgcgtcagcactattatgataaagtattgatagaggaatcgctttatctggcgaatgtgttgaagatgaatgacgaggagctacttcgattgaaagagttatttgacttaacaggttctgaagagaagatcgctacctggttcatgaagaattataacttaagaatggtggtactgactgccggtgcttcatacagtacggtttacacgccggaagaaatttcaacgttacagaccccgaaagtggaagtgatcgatacggtaggagcaggtgatgcattttcggctgccctgataatgtcactgttacatggggcgaaactaagtgaggcacatcggtatgccgtgaagattgcagcgtttgtttgttccaatcagggggcatggccagcatacgaataaattaaggatgtttcaatgtaagataattatgtataggtttacgtttatgttttaaggcaaaaagatggttagttttaggtttttaatttaggttggtaagaaaggtccggtatcctccgggccttttaatttaatggtaagtgacggattcagcctgagtttggtatattattttcttaaaggtgtccggcattatattaatcttgtctgttgtcagttccggcacgttataacttttcagtaaggtcatattttgttccgggctttgttgaggtaacagaaatgccttgtaggcttgtccctccttatcgaagtaagtaatgtacaaacgagtataagagccatcgtccctgcgcgaactgaaaacgatccatcggccattgctgctccagctatgataactgtcggaatctttgctgtttgtttcatctaaagggtatatggaatcgttctctaaattctttacatatagatcagcacttttatgccagatatggaattgtccataattgctttgtgtgaaaagcaggaaccgtccgtccggacttatgcggggaacggatgcactttgtccgcgtgcggagcaatccacttctattaccggttcaccgaaactacaggaagaagaatcgaagggcaagctcattatattgtaatgtaaacgatcgtatttacgcagaaaatcggcagtcgttatcgacccggaatctgaacgtaaagtattcaggtcggctacacaataataaatccggttgccgtctggtgaccaacaaggaaatgtctccagcaaactgtctgttttgaatatattcctgactttcttttgttcaatatcataaaatataatatccgaagcctggtctatcacttcaaccttctcccggttcatcgtatggaaagcctgtccagttttattagaggagaacacgatccaatctctattcgggtgccaggacggatagacagccccaccgagaatcgaatcatgacggaaatcgatcttctcgatcttttctccacgtgcaataattgttccgctatgattcgtccggacatgaaaaagcatgttccgtgtactgtaattctgatagttgtggcagtttacacaatgattctcatggaaatcgaacgtacggttattttcgtaaataggctgttcctcaaatgtagtcaggttgcgttggtataatcccaattggcgataaagcgaatatcccggttcgatcagacgataagaaatgtaaggatcgatattttcgttggcgatcccgattgtataggatggatagcgtacccattctttcccggtatttgcatagattgtcattttcagtggctctcctttatgcttgcgaataaaatcctgccagtctggttctttaaaacagattgaaggcgttccggaagaagatgcttccaactgtgaatgtttcccggctaaaaccgcaacgaactctttaccgggagaacgtaccagaaaattaagcggagcaatattaggaggaatgatgatatctttatagtctggatagatagataccgattgctgtgcatctgtataggcagcaggtactccgggttttgacgaacaggtagtaaacaggcaaagatacaatgccaacgtcagattcagtatgtatattatttgttttttcattagttgacgcctcctttcattaatgattgatatttagccatgtcagtttcattaattatattttcgcaataaaagtaataagggtagaagttactatattcctttcttaattcttcaaagttatccgggtcgacagaaccattcctgacgtagcgggtaacaaactcttttacccgacttatcgtttgcggattgattttgaaatatttcagaatatcagcattgctggtcaggctgtataagacgattgcctgttcaacgaggggaggtaattgctttcctgcataagggcgggtccggttgaaagtttccggtaacatttttgtgtataagcaagcagccagtgatacttcgaatgcctgtaaattccgagcgttcgttatctgcacgttatatcctacaaaaaccggggagcggtattcctgctcgaagtgatcttccataggaaccaattccaatattttactaaaataaggatgggtcattatcttctcagggttagcgaccagaggcatatatttgcgtacaaaccctctttcggtgggaacctgcatcagtagatataaatatttgttagccagcacatattcctcattcagtaatgaacaaaagaacagttgtttcaatgtatagcaattcgggccgtcgataaccattcgttccattgcctgatgataggcctgatagagcagtccggtagcgaagcaacaatcggccagatataggtcggttccgtcatccggctggccaccgcgattaattaatcccgggtctggatactgataagggatctcgaataaacgggttagtagctggttggtctgaaggagagcgatggcatgataagcggcaacgctacgggttggatgcttagctttttgtgctatttctatcatactattccagtcttgttcttgcataagacactgtgatgtagctgttaaacgttcattctctttgcctgtccatccataaatatagagtgttgcgaataagagaacagagatcccccatgagaaacgatttgaaggagttacttttggtttctctttttttaaaaagcatctttttaaaatagcgataactccggtacataataataaggcaaccggccacagaaagacaaccgaaggttcctgctggtaataaagattcgagcctttctgaactaaataccatataaccagaatggagggcaggagggaaaaacattcccatttcccttgtaaagagaagatatatttaagcagacataccgtagcggtcaggatcaatgagagtaacattccacccagtatgggttcatgaaaggataacagtaggaaacgtcctgtacaaagcgcttcaccaaacggttggttcaggataaactgcataacctggcggtcaaaaacaaataagctatgttgttccgccatataaaacatatctttatataatatgcctgtgaaaaaacagaatccgaagaaggatgataacggaaacaatggaatgggcaatttcaaaaaagtctttaacatcatactagctttaacggttaaatatacaaaaaaagaaagactagaggtctttatacatgaaaagggattatccggtaacgaatatcccttttcagattattaataataagtagtttacttatatataaatcttctattaatcacccaatcaatattgtctttccagcaaccatgcatcctggaaattaggagcatatttagatttaatagcgtcgcggctgtcggctgcatcggctttatcattgaagctggcaacgatcacacgcaacataccttgttcgttttcacctaacactgcattgtagccatcattctgcatacgttctttcagggcgtaagcatttgttttgtttttgaagctaccgattactacactgtaacgtttcagacggcttgcatcttcaccttgtgcggcattgattctttccgcacgtgttgtcgcagttgaagttctgggtttggaaaccggagcgacttcctctaccacctcttcttcttgttctactacctcaacaggagctgtagattctttttctttggcttgttcgtaagcagccttataagcactctgtttaggtttacatgagccgaatgctaataccatacttatagcggctccaaataaccaaatcttgttcatactgttcagttcttaaattacttgtgcaaagatataaattatatttactaatttcgcacacagaatataatatattataatgtacatgaataaatctattgcaacaatggttatggcaacatccgtattactaggtgcttgtaaccaagatgctaaaaaagcagaggacacaagacccgttatcggacgctcggaaatcaagattaccgacggacgaatgacgcctgaggctctttgggctatgggccgtatcggagggatgaacgtatctccggacggacaaaaagtcgtttatacggttgcctattacagtgtaccgttgaacactagtaaccgggaagtatttgtaatgaacgccgacggatctgacaataaacagatcactcacactcccttctcggaaaatgaagcaacctggattaaaggaggaacaaagatcgctttcctttcgggtgaaagtggtagcagccaactttgggaaatgaatccggacggaaccgatcgcaagcaactgtccaactatgacggcgatatcgaaggatttgctttctcgccggacgaaaagaaagtcctttttatttcgcaggtaaagacggtaccgagcacagccgataaatatccggatctggataaggctaccggtatcattgttactgacctgatgtacaagcattgggatgaatgggtgacaaccgctccacatcctttcgtagccgacttcgatggaagcaagatgagcaatcctgtcgatgtgatggaaggtgaactgttcgaatcgccgttgaaacctttcagcggtattgaacaactggcatggaatactacttccgacaaggtagcttataccagccgcaagaaaacaggaaaggaatacagcctttctactaactcggatatttatgtatatgatctgaatacgaagcagacggtaaatatcagtgaaggtatgatgggatacgatactaatccgcaatactctcctgacggtaaaagtattgcctggttgagtatggaacatgacggttatgaatctgaccagaaccgtctgatggtaatgaacctggagacgggtgagaagactttcgtaagtaaagcgttcgattccagtgtcgacggattctgctggagcaaagatgctcagaagttgtattttacaggcgtatggcatggtgagagccaggtatatcaaatagatctgacaaccggtaatacactcactccgttgacaagtggaatgtatgattacgagggtgtgactttgtgtggcgataacaaattgctggcaaaacgtcattctatgagtatgggtgatgaaatctatgctatcgatctggcaggcgatcatgctgttgctcagttgactactgaaaaccagtatatctacgatcagctcacaatgggtaaggtggaagaacgttggatgaaaactaccgatggcaaggaaatgcttacctgggtgatctatcctgttaacttcgacccgaataaaaaatatcctactttattgttctgccagggggggcctcagagtccggtcagccagttctggtcttaccgttggaacttccagattatggctgccaacgattatataatcgtagctcccaaccgtcgcggtttgccgggcttcggtaaagagtggaacgaggccatcagtggcgattacggtggccagtgtatgaaggactactttacagctattgacgaaatggcgaaagaaccgtatgtagacaatgatcgtctgggttgtgtcggtgccagcttcggaggtttctcagtgtattggttagccggtcatcacaataaacgctttaaggcattcattgcccacgatggtatcttcaatatggaaatgcaatatctggaaacagaagaaatgtggttcgccaactgggatatgggcggtgcttactgggaaaagaacaatccggtagctcaacgtacattcgctaattctccgcacctgtttgtagacaaatgggacactcccatcctgtgtattcacggggaaaaggattaccgtatccttgccggtcagggaatggctgctttcaatgctgccgtacttcgcggtgttcctgccgaactgttgatctacccggatgaaaaccattgggttttgaaaccgcagaacggcgtgttgtggcaacgtactttcttcgaatggctggatcagtggttgaagaagaattaaaaaatgttcaccgttcaccctttaagggcttattagttgtaaaacagtatattgaatgtgtgcgatatgggtgaatggtttatataaaccattcaccttttttctcctttctagattgcttattattagtacttatgtctttgtctattgaatgacagatgcctgataactaaaccattccctatatcttatttgcttaacgaccttggtcgcaaagcttgacgacaaaggttgcttgatttgtaagttattactaaaggcttagttcctaaccggtttgatgatagtgggtgacgggatgttggttaaatggtacttattgctggtatcgggtgaatgttttttgcaaaaactcaatcttacatgcttacctggagcgtctttgcgtcttgctcttagggttgtaagacgtttttctgccggctgccggcttagccgatttgaagttgctacccgatgctgaccgttcctttttagcgggggaaggcttggcctgttgacttttggtaaccgtactgtttttaggagcagtactgcttttcccggcaggtttacctttcttagctgaggcctcttctgttttcactgagttggcaatcttcttgtacaatgtttcggactcttcgggattgaggttgcggtattgtccgattttcaggtctttcaggtgaatgtgcatgatgcgggtgcgttgcagttttgtgacattgtagcctaaatactcgcacatacggcgaatctgccggttgagtccctggcgtaaaacgatattaaacgagtttgttcccttctgggtaatctcgcatttacgggtgacgactcctaaaatgggaatgcctccctgcatacgcttgataaaatcagttgtaaccggtttgtctaccgttacgaaatattctttatcatgattgttgttgacgcggagtatcttgttgactatatccccttcattggtaagcaataacaacccctgagaatctttgtccaggcggccgatagggaagatgcgttcgggatgcccgatagcatttattacgttgtcgcgttcggccggatcggttgtgctgacaatgcctaccggtttgttgtaaacgatgataatcgattcagctttaccgctgatgatctcgccgaatactctcaccacttgtccgggagagacctgggttcccatttctaccctttttccgtcaagggttacggcaccttgctcgatatatttgtcggcttcccgtcgcgaacagaatccgctttcgctaatgtatttattaattcgtatttgcattgtgaaaactggaatctgatttagtgaaggcgcaaagataatataatttatcgaatctcctccaaagcaatatacctaacgttgtcaggctgaccggaaaaccacaccagataccgatcgctccccaatcaaatacaaatccacagatgtatccgattggtaaagccagtccgaaatgacagaagaacgccatgtaagccatatactttacatcggctatgccgcgtaaagcgtttgcgaatagtatttgcaaaccgtctccgaactgatacaggatgaccgaccaggataaaagagctaccatcgctaccacgtcatgctctggtgtgaacagatatcccatattcttatggaaagcgaggataaacaggacaaatataacggctactcccataatcaggtgcagcccggcgaaggatgcccgacgtatatccagccagtctccccggcctttgaaagcacttacccgtatagtaacggcggcggctataccgtaatagaccatgaatcccagtgtggtaatgactccaagtacctgatgggcagccaatgctgtactgcctatccatcccatcatgattacacttaagctgaatgaacctgtttcgacccccattaacaggccgacaggaaatcccatccggatcagattgctcagattcacccggttgatgacaccttccttgaaacctttcaggtattctttgtatttattatgccgcaggaaaaggataaagaaaacgatgaatgtcaggatacggctggcgagcgtagatattccggctccggtcagtcccatttccggcacaccgcatttaccgtaaataagaaaatagttcccgataatattcaatacattggctcccagcatgatccacataggagtaaccgtatcggtcgtcccgtcgctgaattgtttgaaagagttgaacaacatggcaaatacgacggaaaataactgaagaatataataaggaacgatataaggcatcagctcttccggctgatccaatatctcaatattgaagagcaatagaagcatgcaaaggctgagtaatataccgacgatgaagttgataaataaactgttcttcagtgtttcgccggcttttttgagctctttaccggcaaaaagtccaccgataataggagtgaggccataggagaaacccattccgaagataaaagccaggttaaagaagttattgacgaacgaggcggcagccagttcgttggtactgtgatgccccaccatgatgttgtcggcaaacccgacaataataatgcccaactgtcccaacatgatcgggacacccaggcggattgtatctttgtaatgttctttataagcagagaattgtatcattcaagtatctcaaccgattcgataaccacattttccaacggacggtcctgtcggttggtcttgacattttggatggcgtccacaatatccaatccttctaccacttcgccataaaccgtatattcattgtccaggaaaggaacgccgccgattgttttgtaggcttcccgttgttccggagtcagtttggcttcatccttacgcttttctgcttccatttctgtcttgccgatcagggtatcgcggataatagccagttcggctttgtcaccactttgataagccgctttgatcttggcactgttttctttttgcaggcgtgcgaaaatcgcttgtttcaggcggccttctttttgtttctccatctggtccagttcggcatctttgtgtacctttccggtgacgatatagaactgggaggcagaagattctttctccggattaacctcgtcactagtacgggcggcagaaagagctccttttttatggaaatatttcggataaacaaattcggccggtacggtatatcccaggtcaccggctcctaactgtttactcataggagcatcttttgaggttacatcaccaccttgcaccatgaaatccttgatcacacgatggaaaagcaggccgttgtaagttccgtcctctaccagtttgataaagttatcacgatgtttcggtgtttcgttgtatagtttcagtttgatgttgcccaagctggttttcatcaatacctgtgtctcttttgtttgcgtttccattcttattttgtttaatgattatttatcgacaagagtcattgtcttgatctttatattctttaacggcctgtcgtcctcatttgtttcgacaaactgtattttatctacaactttcattcctttgacaacttcaccgaaaacggtatatttattatccagatgaggtgccccgccttcaagcatataggcctggcgttcttcgggggtaaaggttttattgtcgctcttctccatcttatccagttccatttcagtatagaactttccggtcacgatatagaattgcgtaccggatgaggcgcgttccggattttcgtcgtcactggtacgggctgcacatagcatgccacgtttgtggaaatatttcggataaatgatttcggcgggaatggtataacccggatcaccatcgcccaaatgctgttcgataggtgcatctttcgaattaatgtcgccgccttgtatcataaactgtttgatcacacggtggaacagtaggccgtcgtaacgtttttctttcacatttttgataaaattatcccggtgttgcggggtgtcgttaaataactttaccttgatctttcccatgtcggtgtcgatctgaacgagtgtctcaacatcctgcgcttgcgaatgaacggatgtcaataatccggcaactaatacacatatagcaaacagcttcttcatcttcgttttattttgttattaaggcaacaaaaatagttacttttagtcgttaacgcaaccttttaacacaaccttttcatgtgatgcttgttccttactggtaaaacgtctaaacaaaacacatttatgaaatcatttgttaaaggagcgatctttctgctcgggttaggattgttgccgggccatgctcaggctcagaaagtggtgatagaggatgaagtgccgaactctatcatgtttatttcgatggataaggccggaagtgaaattgtcaggattatgaatgatacggaaaataagcgttttcatgatccgaaagcaccccgtttcgtgctgacagacaggaaaggtaagtttgcattaggtatcggcggatatgtaaaagcaactgccgagtatgatttcggaggtatttccgatgatgtggacttttatccttcgttgatacccaataaaggggcttctaatgtaaataaccagttccagatggatgtaaccaccagtacgattttcctgaagctggtagggcggactggtaaactgggtgatattgtggtgtatacagccggtaacttccggggcgatggaaagacattcgaattgcagaatgcctatgcctcttttatgggttttacggtcggatataactatggtttatttatggatctgtcggctcttccgcctacgatagactttgccggacctaacggacaaatattctatcgttccacacaattcagttatgaacgttcttttgctaaaggatggaaagccggattgggagtagaaatgcctgtggtagatggtataactaataagaatacgaatatcacgactcagcgtatgcccaatttcccggcctatattcagtatggctggaatagcggtcatgtgcgtgcagccggtatcgtccgtagtatgacttatgataatttggagcaacagaaagccgagtcgaaagtgggatggggtacttttgttgcaacaacatttaatctctgtaaaaagctacagttttacggacaggcaacctatggtcgtggcatcgggcaatacctgaacgatttaagtaatttgaacgtcgatattgtgccggatccggagaaacaaggcgctatgcaggtacttcctatgatggggtggtatgccggattgcagtataatatcacaccgaaagtttttatttcaagtacttacagtcaatcccgcttgtatagcgacaacaactaccccgcaactccttccgaacaataccggtatgggcagtatctggtggcgaacctgttctggaatgtgactccggatctgcaggttggcgccgaatatcttagaggatggcgaaccgactttaatgatcagacacgtcatgccaaccgtttgaatgtggcaatacagtatagtttctaaaagattaagcatataaatagttactgaatgagaatcttgtcatcgcgtttcaagcgcaggatgacaagatttttcttattatgactgttaatgtgtgttaaataatactcatcgacccctagacgggaatcttttgtgtgtatcctttataaacagactaaaaaaaacaattattttataaagatacttatgagagacacgatcatcatatcgcttcttcaaaaatatataaaagatcaatgttcggaacaggaattgcgaacattgcttcaatggctgaaatctccggatagccatgccgggctggattctgctatccagccgctttgggatgctatcgatagggatatggcccaaccgacttcagaaagggaaacagaattacggaaagaagtttcttccttattatcaaagatcgaacataaaaataagtccgctaacacccgtgttaggaataaaaaccgtttaaacggtttttatcggattgctgctattttaattcttgctttcagtgtgacgttcggtttattaaaaatctatgaccgtccgcaacggatgattacttatacggaaaagatatcagcaaaaggcgaaaagaaaagtatacagttggcagatggcacgaagattattcttaattctgatacaaaggttcgcatccccaataattttaataaagaagaacgtaccatagagatagaaggagaggggttcttcgatgtgactcccgatccggataaaccttttgttataaaaagcggagaggcccaggtaaaggtattgggtacttcattcgatttcaaatcttacaaagaagatgaatttatcaaactaaccgtatcgacaggaaaagtcagggtaaatgttgccgaccaggaccttcagctggctgtttcaccgaatgaacacctttcgatcaataaaatagacgggaacgttcgtaaggaaaccattgaggaaaacaactatataaaatggatacatggttctctgtattttaacaaagaaccgatccgtgaagtaattaaaacaatcaaccgtacttataatcgaaaagtgattctgcaatgtaaagattgtgattaccgcattacgggtacccatgataacaaaagtatcgaggctgtaattgaagccatctgctttacgacagggcttcgaagccgactcgaaggagataatattatattaatatgataaacattaagtctaacataaaaaaacggaatgcctatgataaacactagatgataaaatacatgaaaaaagcagtagtgctgctacactactgccttcactgattttcagcagggactttcagaacagtattgagccactgggttgtaaagtatctctgcctgtcttaacaaacatcatttattaaaacattacaaatgtatgaattataatctaatctataacaagactcttatgcgaacttcgttaacagtttgtgctatcgctctgtcgtcgcagttactttgtgcggaaggagctttagggcaaagtcttaaagaaaacgatatcacttatgtagtgaaacagacgtcggtcagcgacgcttttgaacaattaagtaaaattaccggctttaatttcttttatgacgaatccgttttaaaaggcttgaaaaatgtaagtgtacaaattaaagaaggttcgatagatactattctgaatgaattatcccgccaaacgggattgtcttttaaaaagatcaataatacgatatcggtcagtcggggacaagttaaagcttcttttccggctgttgaacaaaatgtcaaaaaaataaccggtactatccgtgataatcatggcgagcctattattggtgctaacgtgtttgtaaaaggaactaccagtggtaccgtgacggatatggatggtaatttttctctggaagtaccggagaaaggaactttggtcgtttcatacatcggttatctgacaaaagaaatgccgataggaaaaggacaacagagtgtggaagttgcgttgattgaggatacacaggctctggatgaagtcgtagttgtcggttttgcgaaacagaaaaaagccaacctgaccggttccgtaagtagcgttaaaatggatgaggtgatgggagaccgcccggttccgactacaggtgctttgttgcagggagcagttccgggtttgcaggttacttccggtagcggtgagcctggtggcggtctggattttaatattcgcggtacaacgagtatcaatgacggtgacccccttattcttgtcgataatgtgccgttctccggttcgttgaacttactcaatccgaatgatatcgagtcggttacagtcctgaaagatgcggcatctgcctctatctacggagctcgttctgcttttggtgttatcctgattacaaccaaaggtgtccagaaagaacagaaggtacaactgacatacagtaataatttttctttttcaaagccaacgaatttgccggtaaaagcgaacccgttccagaccgttcaggcctattcggatatgggttatattacttattattccggtcagactgtggatacatggctggatctgcttcatgaatacggttctaatccgtctgcttacccggatggatatgcagatgtaggcgggatgcgttatcagttggcacaaacggatataatgaaggatttcttgtcggaaacaggtttccagcagaaacatgatttctctgtgagcgggggtaccgaacgttcttcataccgtatttctttgggatatacgggttccgatggtatcatgacaaccgatatggatagctataaacgttataatgcgaaaggttttatcagttcgaaaataacgaactggctgacaggacagttggatcttagtttctataaatcggataaaggcatgcctagcggtgccaactattccaaggcggtgtgggctccgtcttacaacccgacaggaatgatcacgatcaatgacgaagatctatattccggtacggcaggtaacctgactcgtctgggcggtcagaacacgaatgcgatctctgatacgcgtgtttttgccaagttgatagcaacgccgatcaaagacatggttctgaatgcagagtttacatatgataacctgaatgaaaccgagacaaagtattcaaaacgtatccgttttgccaatgccgataagttctcggatgaatacacttcagattattcaacgtatagccgccaacgtgctgttacaaattatacggctttgaacatttacggctcatacgctaaaagttttgccgataataatttttctttattattaggatacaaccaggaatccaatcattatgattatctgaaagctgaaacttcaaatatgatcaatgacgatatgccttcgatttcccagtctgtgggtgtacagaaagcgtatgataagtttaccgaatatacggtgatgggatttttcggacgtttgaattatgactacgcaaaccgttacctgcttgagctgaacggacgttatgatgcttcttccaaattcccgtcgggtagccgttggggattcttcccgtctttgtctgtgggatggagagtgatggaagaaagtttcatggaaccgttacgcgattatattcctgaatttaagataagaggatcaatcggtacggttggtaatcagaatatcgatccttaccagtttgttccgagtatggagtccgcaaaatctacttggctggacaataatacacagccgattactctgaagcagccgggtctggtgagtggaaatttcacctgggaaacggttcgtaccttaaacctcggtttcgatatcagtgccttgaagaatcgtctttccgccaacttcgatcttttccgtcgcgatacgaaggatatgttgaccagcggatcgcaattacctgcgactttgggtgcaacagcacctttacagaatgtagccgatttgaaatctaccggtttcgaactggaattggcatggcgtgaccagatcggtaaagtacattataatatcggtttcaacctgtatgattacaaagcctatatcacgaagtttaaaaataatgtagctggtgtgattcgtacttctgataataaaacgtatgtggaaggacagcagataggtgaaatatggggatatgtaacagataggttgtatacggtcgatgattttgtagaaggaactttggatgcgaatctgaaaaatggtaccctgaaagacggtattcctcatgtggaaggtgtgaaaccgaatccgggtgatatgatgttcaaggatttggatggcaatggtatcatcaattcaggaaatgaaacgatttatgatccgggcgaccgtaagattatcgggaataattcattacgtttccaatatggcataaacggtggtttgtcatggaataacttcagcttctccttccttttacagggagtcggaaaatgtgacaagtggctgacaaacgatttgatcttcccgtattattatgaattcggtacgatctatgaacatcaattggattactggactcctgaaaataccggggctttcttccctcgtttgtatgaaacaggtatgagaaatacgaactatgctgcgaatgttcgtgcccagacaaagtacctgactaacggagcttatctgcgggtgaagaacctgacactgggatatacaatccctcagagtgtaatttctaaaattggtatcagtaacctgagagtgtatgtttctgcagaaaatccgtttacgttcgatcatatgcctaaaggtctcgacccggcagtcgaaagtaaagcgaacggactgggttatccgttcatgagttcgtatgcttttggcttcagcgtaagcttgtaattctgtattattatgaaactattaaaaagaaagaatatgaatttgaaaaaatatatcgtattaccggtcatagctttaaccggtttgggattgacgggatgttcaagtgattttttggataaaatccccttggaccagcagactgaggcgactgcatttaaaacgaatgataacttcaaaacgtatgcctggggattgtatgaatatttcaacggatttccaacggatggcggttatacgcctgccaatatatcgagtgagtatgatacggataatataatttatgccaattcaggaggagagtccgattatgcatatcagttaaagaaattaccggcaaccagcgattcctggagctttacgtatatccgtcgtgtaaatataatgttgcagaatatcgatggttcttccatgagtgatgtcgataaagaccactggagaagtgtcggttactttttcagagctttacgttattttgatatgatggcggcttatggcgatgtgccctggattgacaaagtgttggatgatacggatacggaagaactttactgcgaacggactccgagagacgaagtcgccaaacatattctggaagagctgcaatgggcggaagaacatatcaaagaggatggtacaggaacaaatacaatcaatgttcatgtggtcagagccctgatttcacgtttcggattgtttgaaggtacctggcgtaaataccacggattgaatgatagcgaaacgtatttgaaagcttgtgctaatgcatcagaaaagttgatgaatgcttatccttctatcatgcctaattatgatgacctttacaactcggaagaattggtcggaaaagcaggtgtgatcctggctaaacaatatgaaacggatatggtaacgcatagtatcacacgcgtgatccgctcttcggcatggtatgtcgatctgacaaaagatgctgtggacagttatctgtgttcagacggacgtccggtttctaccagtaaggtgtatgaaggcgataaggatctgaatgctcagttccgtcaccgtgaccgccgtttatattggacggtagttcctccttataaagtaaacttgaccggtgctgccggtacgtcattcggttgggagcatacaggagtggccagtgaccgtgaatatattgattatatggaagaaataggcggttcggcaacaggcaagagtttaccggtatctaacttcgtcgggtatcaggtttccggttttccgcacttccgtaactacccgaacggacagggattccttgtaacccatttagggttctatttctggaaatattataaccgtcatgtcgataatatggcgttacgttcttctactgtcgattatctcttattcggtatagaagaagtgatgctgaattatgctgaagctaaatttgaattaggcgaattttctcagtccgtagctgatgccactatcaataaacttcgtgttcgtgcggttattccgtctatgaatgtgtcggaaatagatgcttctttcgatttgaacagagaccagagcgtagatcctgttttgtgggagatccgtcgtgagcgtcgtatagaactgatgggtgacggtttccgtttccgcgacctgaaacgttggaagaaaggggaatatgtgaataaacaaccattaggtgcatgggtgaagagcagtgactatgatggtaagctcaatattctcaatggggctgatgagggatattccatcctgttcgcaaaaccgtcgggatggctggaaaaatattatctggaaccgattcctactcaggaaatagcgttgaatcctaagttaaaacaaaacccgggttgggaaactgccgaataattagtatcgatactctcttaaaggttgtttccggactgtgttgtcgtagaaacaacctttattatttaatacataaaatatgaacactagaaaatatttatatatcgttgcttttatttttttatttgccaatatatcgtttgcagccaaatggaaggctaaacatgtcatattgatcggcctcgacggctggggagcctatagcgtggagaaagcggaaatgcctacggttaagaaactgatggcggatggttcctatacgttgaagaaaagaagtgtactgccatcttccagtgcagtgaactgggcttccatgtttatgggggcaggtcctgaattacacggatatacggaatggggatcgagaacaccggagcttccttcgcgggtattgagtaaagacggtattttcccgactgtatttggcctgttgcgtgaatcggaaccgaaggctgagataggttgtgtctgcgaatggaaagggatccgttatgtagtggataccctggcgctgaattacgacaagcatgtggccgaggcttcaaaagaacctgatgctacggttcgttatgctgtcgattatatccaatcggctaagccgaacttgtgtgcggtcatttttgataacccggatcatatcgggcatgcggacggacacgacactccggaatattataatatgctgaaagtattggatggttatatcgctcggatcgtagaagctgtaaaaaatgccggtatgttggatgatacgatctttattgttacttccgaccacgggggaatcaataaaggacatggtggtaagacgatgcaggaaatggaaaccgctttcattatttccggaaaaggaatcaagaaaggctatgaattttctgaaagcatgatgcagtttgacacggcggccactattgctcatatcttcaatctgaaacagccgcaggtatggatcggtcgtccgatgttacaagtatttaagtaataaggaaaagatacaggtaagaaaagaaaaatgaataatcatataaaaatagctttagcattgctgccggtacctttgtgccagacggtagctaaagaaaacaagactacccgcccgaatatcgttattatttactgtgacgatatggggtatggggatataggtgtgacggggcatccggatataaagactcctaatctggaccggatggctctggacggtatgcgctttacgaactattacagtgcatccccggcttcaacagcaagtcgttattctttgttaaccggacgttatccggtgcgtgccggtttccggtgggtattgagcccggatgctgaaaaaggcattcatcctcgggaactgacgatggccgaattgctgaaagggcagggatatgctacggctatctatggtaaatggcatctgggaagtacgaagaaggaatatttgcctttgcagaacggctttgatgaatatgtaggtcttccgtacagcaatgatatgatccccccgaaatatccggatatagctttgatgtgtggaaatgatacgctcaaaatgaatcccgaccagtcggaactgacggcgctttacacggaaaaagcgatatcgttcattaaaaagcataagaaagaaaacttctttgtctatgtcccttatgcaatgcctcatgttccgttatatcccggaaaagcctttatcggtaaatccaagaggggtacttacggcgatgcggtggaagagatcgactggggagtaggggagattttgtctgctctcaggaaagaaggtcttgataagaatacgatcgtttggtttatgagcgataacgggccctggctgccccggaacgaggaaggcggatcggccggtatcttccgcgacggtaaaggcagtacttgggaaggtggtgtccgtgtaccatgtttcgttagctgggcgggccatctcaacggccaggtcaatgaagaggtcattacttccatggatgtttttgcaacttccgtatggatgggcggtgcaaaaattccgacagaccgggtcatcgacggaaagaatgtagcctcttacctgggatacgaaggtgtagctccgaaaccggaaacgccattcttctattttggtatcgaccatcagttgatggcggtacggaaaggcaaatggaagttgcatgtgaaaacatacagccagttgggactggattattttaagggcgaattgcctttactgtttaacataaatgccgatccttcggagaaatataatctggctaccaaatatccggatatagtaaaggaattgacggccctgatagaagaaaagctggaagaagttaaaacaaccggcgactttttcagtaataactaagtattatttatacaagataaaagctgccagcaacaggcttatggacatatccgcatgtttgctgaaataggcttttataaatttgagcgcctctgaaatatgctcctgtacggtattgaccgaaatacctaattcggcggcaatttccttatgagacatactttcgatgcggctcatgttgaatatcttccggcgttgcgggggaagctggctgattgcattctgaaggatcacctgatattcagtgtagattattttggaatcgatcgcttcttcctccgtaactttttgtgtggcaagtatttcttttaccttttcatcgatatcgatatcccggaaataattaagtatcctgttgcgtgccattgtatagaggaacgatgaaaaagagaggtccgggttgatgaagttacgtgattcccagatacggataaatatttcctgaacgatatcgctggcttcttcttttgatttgagtaaatggaggcagaagtaatacagtttgtctttatagcgcacatatagctcactgaaagccgcttcattatttcgggtgagtaagatagctaattccgtgtctgttttttctttgatcctcatgtgtacgattacatagtttggaacaatattacagatttttgatgagaaaaagaaattcccggtagaataactggaaataacagctccaccgggaattggtatgattgttttttgttaaaacagtttttcaggatattcacctgcatcgaccaatgcctggatcttatcgacaacttcctgacggtcttccggataagtaacgccgaaccatttgctgttcgtatccaatacttttacagtagccgtatcggtgctgatcagcttatcgaccatcaaaggaatgaaaaattcgcttttcagattttccatattcttcggatcgctcaggaacactttgaagaaatctttgctgtaagcgaaatagtcgggtgtgaagccccagaagttcatacttaccggagttgtgtcgggagtagccacccattcgccgtcgtcgccgatgtatttaacttcaccgtccagacgttggatcttggtgcgttcgacaacggaagtcaacaactcgttttcgtttgtgctgcaaataccacgggatacggtaccgctttcgctcaacgtatttcctacgcggaaaccgaccattgcatacgtgttttcagaaccgtcaggcagtgctgaaaggaatttgcccattacctggaaagaatcgcggccatagaagtcgtcacagttgattacggcgaacggttccttgatcacgtcggcacccatcataacggcatggttcgtaccccatggttttgtgcgttctgccgggcaggtaaatccttcgggaagattatcgatagcttggaatactaattcgcaaggaatatgaccttcatatttagaaatgatcttatcacgaaaatcttgttcaaaatctttacggataacaaagacgagctttccgaaaccggcttgaatagcatcgtagattgaataatccatgattgtttccccgttaggacccagtccgtccaactgtttcaaacctccgtagcggctacccataccggcagccagtagaaataatgtaggtttcataattcttttattttaattagatagtgtatttttcattctgctggcaaaggtagaaaactattgataattgacaattcacatttggaattaatttcatcttatcaggcagaaacagaatctcgattatttcacttccagaaccacaatcgatttggctggcatactgatcttcagctgacctttttccacttttgcaccgttgaaagctaccggttttacgagatcgggcttttcaaaagtgttgtggtcgttgatggaaggtgaggtgaggatacggccgttcacaccggttattttttgtccttgcaggtcgagggtgatgttttgtgtgttgtctgtatctacgtttgccaatgtgatgtggatcactccgcttttgtccctggaggcggaagcactcagcatcggaacttcccggttgtcacgtaccagggccttgtcgcagatcaggtccatcggaaggaatgtggcatcctgatgcactttatacatttcgaagacatggtacgtcggagtcagcatcattttcggaccgttggtcaggatcatggactgaagtacatttacgatctgggcgatattggtcattttcagacggtcggtgtatttatggaatacatttagggagagggcggcaacgaaagcatcccgcattgtgttttgctggtaaaggtgaccattgatagttcccggttcttcgtcccaccaggtaccccattcgtcgagcatcagggctacgttctttttcggatcgtatttgtccatgatggtgatgtgttttttgataacatcttctatttcgaggcatttgcccatcgtccagtaataatcatctttgttgaagtcggtagcggatcctttgctaccactccatccggtcacagtgtaatagtgcaaggaaagtccatccatgcgaccacctacgtttttcatcagagtctccgtccagttgtaatcgtaatcgctggcaccgctggcgatcttgaataaacggttgccatcgtaattacggcaataagtcgagtagcggcggtagaggtctgcataatattccggacgcatactacctccgcaaccccaactctcgttgccgacaccgataaactttacgttccatgccttatcgcggccattttgccgacgcaggcgtgccattgggctgtcgccttccgaggtcatatattcgatccatttagccatttcctccacagttccgcttcctacattggcactgacataaggctcacaacccaatagttcacagaggttcaggaattcgtgggtaccgaaactgttgtcttcgattgttcctccccagttgttgttgaccatcttagggcggttttctttagggccgatgccgtccatccagtggtattcgtcggcaaaacatccacccggccagcgcaagttgggaatatgcaattcttttaatgcctgcaatacgtcgttgcggtaaccttgtgtgttggggatatccgactccggaccgacccagaggccaccatagatacaagttccgaggtgttcggcaaactggccgtagatatgtttactgatctgttgtgtaccctgttggggatatacacggatactggcatctttctgggcgaacagggggagtgccagaaaagtaagggcactaatgattaactttttcatgatattttttttgagattagtatttgtctatttttcgggagttaatttgtataatacggatgcatgtggttgaaggctgcaactgatcttgtctcttttttgatcgacctctttatcgctccacatttccgttacgcggcaattttcgatacccaggtctttaagaggtatgtcgataacggatataccttcatcgttgaggttgaacaatgccaggtacacttcaccggttttttcgtttccggaagtgatagctgctttcccgtcctgctggaaaagctggcgtacatccgtcccttctcggtgcattctgagcacttctttatttgtcaacaaggaaagggtaaactcgtcgttgctgggcaggtcgccaccgaacatcaacggggaacggaagatacagaacaggttcattaaagtatattgttcgtcgtgggtcaggcgggtcatacggtcttccccccgttctccgcggatagagatacgtccgagcgggatcatatcgcaatcaggccaagtacccggggcaatatacggataccatttccgggctacatcgaacaggtgggtgatatgaggccaggtatcccaaacatcgtctaccatacgccacatattcgcatggctgcgtacgtggtctgcgttggtaatcggagtttcgcctggggaagtgctcaatacgatcggccgtccgcaatggtcgatggcgtttcgtattaactcgatttcgccgaggtggtaggggcgcgacagatcgtctatcttgataaagtccactccccaggatgcataaagttcgaagatggaattataatattcctgtgcacccggcttatcggcaacgaccgtgtagttatctctcagccattcgcattgcagttccggcgaatagatctgatcggcagtgatcccgtcggcaccttttatcggcagtttcttttcgacggccactttcggaatgccgcgcataatatgtataccgaatttcaaacctttgccatgtacgtaatctgccaattccttgaaaccttttccatctttagcggatgggaaacggtttacggccggctggtaacgtccgtattcatccaatacataacggggatcggtctgattgtaaccgcctgccttgtcgttttccacgaaccagcggatatctactactatatattcccagccgtattctttcagcttgtcggccatatagtcggcattcgccttcacttcgtgttcttccactgtcgggccataacaatcccaactgttccaacccataggaggggtttgtgcccattctttaaattcgccgtctttgaacggctcgggctgacttgcttcttttttctgtgcgcaggaacaacatagtacggttgctgcgatccataataataactgttttttcatgatatactgttgtgattttttattatgtgtcaaaaatacgttatattttttgtttcgcagtaccactaattcgtcaaaaagggtgtattttgagccaaaaccctacgaattattgttttttatacaaatattccttgaaaccgacaaaaaaaaggccggctcaaaaatttctgtaatgaaacagtgatgagtcggccttttattattttattcgatcaccgggcgatcgtcgggatcgggttccggtgtgggatcgggtttgggagtcggatcgacggggatatcgggtttcgttccggctttgcggcgtgagagggtttcggagaactgcacgatcaatgcgttgacgttgtcgatcaggccggccagcttcgttgcctggtcggcatcgtgagtaatcgtctcgttcaccagccagagggcattgatagccttcacggttgcgcggtaggcatcgtccacctgcgagcggacggctttcaggctgtcgttgctgacacgtccgagtttgacgtcggaacggttcacatacaattcattgaactcattgttcgcctgtttcaataggggaagcacgtcggtaaggcccagggcggtgatatacgcctggttggcttcactttccagtacctggaggcagttggtcacttgcgccgtgttttcggctgccggtttcgaggctgcatctttgtaaggtctcatctcgaactcgatcttttgcgctgcggtctttttttccggcaccgggctgtagagcatggcggcgaccatttgtttgatgtagatgtaaagatcgtcgcgttcgcggtctttttcgttcatggcctgtgtttcttcgtaagcgcgggcctgtagatagaggtcgtcttcgcgtttgaaaaggtctgcataggttttctggaggctttcgatcttcaactcggtggccagggcgggggtggcgaaggtgaggacgttggcgtggaactggaaatgctcggcgttgcgggcgttgttcaagttggtagtaacaatttccttcatggcattttttttataaggtttatactaaaaaaatcgatcagatagttctgaaagtaccctgtcgtgaaaaaaatattttcagaaagctctgaaagtactttttcaatcaaaaaacaaaatcagaatactctgaaacaactaaattgacagaaatataaaatcagaaggttctgaattcattttttgaagaaaaaaacgttttcagaaccttctgaaaacatcaaatcatcaaaacagagctatcagagagttctgataggccaaatgtagtcttttaaaagtgttttacctagcgtctcgtcctgaatttcaaaaaataaactgctctatcctcgcgaaccgggcagttttcaacaaattaatatgccctacttaaagcatatgaaatctgatgtacctatcatcgatctctatttcccctttcaaaaattagtaggagatgtgtttttgggttctaaaatcatgcttaggctttggttttacaaaggtcggtgattttctgttctctgaaaaaaacatttgctcataaaatatgcggcgcattgcatattttatgcagttttctttctgtcctggacagatacttaattgtttgtccttatatttgtcttcaataaaataaataaggtatggaaaaagatgcagaactgaaaagaagcaaaaatgtaaacgagggtgcgaatgtccggaaattacgccagatattaggtatcaagcagagtgcttttgctgaaaagttgggaatagaccaatcggccgtttcccgtctggaaagtcgccgggtgatcgaagaggatacgttgctgaaaatagctaatatatttaatgtatctcctaaaattattcaggaactggaggagaacccgctgtcggtggtggttgagaatacaatattcgaaagtggaagttctaataatggaacagttggatataatgagaaaatagagaacactatccatcctctcgaaaaaatcatagaattaaacaagcaaacgactgaactttacgagcgcatggtagccctcgaaaaagagaaatcagccttgctggaacagttgttgaaggaaaagcaaggataatatagaagtaattgaacctacttttggcttgatccaaaagtagtcaaaagatcaaggctgcacctgtctcactactccgcatcctacattcgctgtcgcctccgaactcgcttcgctcaaacagcggatgctccggccgctcactccggctgctgcgctttacgctcgacagctgaggcctttccaaggaagctctgcttcctcttaggattgccgatactgcctgttataaagtggtcggtatcggccatcccaaaagaacgcttggcgttctctaaaaggccttcggcgggtgagcgtccgcgaaggggaaagacgaagcgttagggaggctgcgctgtttgagcgaagcgagttcgcagacgacagcgtagtctttcaccgtagcagcgaagccggtgcagccttgaacttttggttacttttctttcaagagaaaagtaacattcaaatctgtcaataactgaaatattaatacagggtaagggcagaaacaaaatcagccagattgttatagattaaaaacaatctggctgatttaatttaatgagcaataataaataacaattcgttattttcgataccctgttttaatacttaaacggtgtcatcctcgtatacgccttgtaatctttgatcattcccgggtatccttcttcggcacggggcaggtagcggaaacccgaaactgttacggtttcacgtaaatcgatcaccacctgatgcgggtatttagcccctctggccgtgctccaataggtcgactcctgcaaatcataaattttatcggctgtgaagtttcctccgtatgtctcttcgctgtccgcgtaaccgatctgccaatgctggcgtccgagcggattgccgttttcgtcgagcagatagaattcagcgatggcagccgtatttcctccatcctgtgcattcaatgcttccaggcagaagtgacgggcctcgactggtgcatcgaacctgacttcctgccagccgttgccggcctttaacgaaccctgtccgacaggtttctcatttttcaggtccagattctggccttctttgcggttggtgagcggtgcttcggcacgcaacagatccaggatcggttggttgagtcctttgatcgttgccttttccgggcctttcaggtcgagaacgatgatttcgttttcccctttcttcaaccagcagccgggcatgaacagtgtttgctgcggaccgatttcccagaaacgtcccatggctttgccgtttacccaaaccataccttttccccaggtttgcatatcgaggaatacatcaccgggagtttcgaggttgaaggttgcacggtaataagccgggccttctgcttttttaccggttgtgaactttttgtcttttacgaaagaatagtcaaccgggagattgtatacctgccagtctttcaattcgtcggaagacgattcggtgataagagctacttttttggtgatccctttcctgtcgtggatggctttgtcgaagttgacacgtcccatcgcttcgatcaggatgtccagttgtgaaccggctgctgctgcgggtaacttgatcgtattttctccgcggcggcgatccagacggccgatcagtttaccgtcgatgaaaacctgtgcccagtcatgtacttcgtcgatcagcagtgttgtacccgcttttacagccggaagagtggtacgatacaggatacttccccatccttggtcgaactgttccatcggcttgatgtcgtggctggtcttcggttccggcaggttgtcgaacaataaggctgtttcttttaattcgaattcggggatttcaatgacagggaaagcctccggtatgtcggccatcacttcgcccggttccatataaccggccatgaactcgcgtagtttgtaatacttcggagtggtccatccggcttcactgataggagcgtcataatcgtatgagctgcacattgccgaataagccgggctgtttgcaccgccccagtgtccgaaggtggtacctccgtgagtcatataaagggagaaagaaatgttacggtcgagcatatctttcaggccggcgatcattgtctccgcatcccgtgtctcatgcttgcgtccccaatggtcgaaccatccgctccagaattcgctacacatcagcggggtgttcggacggacctctttcagctttttgaattgttcgtctatattggctcccgtgccgaaattcaccgtccataccaggtcgtcgagcgcgttgttgaggaagttggaactccagtcgcactggaacagcggaacatccgtgaatccggcttcccgcaggatgtcccggttcttggcaatatattccttgtccgtagcatacgaaccgtattcgttttccacctgtaccataataatgttaccgccacgggtaatctgcaggtctgccacttgttttccgatctcattcatatagatacgggtacgttctatgaaataaggatcgttcgtgcgaagctggatatcttcttttttcaacagccaccaggggagtccgcccatttcccactcggagcaaacgtatgggccgggacgtagcatgatatacatatcgtatttctgtgccagccggcagaatgcggcgatgtcgttttgtccggtgaaatcgaattcacccggtttctgttcatgaatattccagaatgcatagatgcagatcgtgttcatgccaagggccttacacatctggatacgatgttcccaatattccacggggatacgtgtgtaatggatttcggcagcttttataacaaaaggcttgccgtttaacagaaatgttttgtcacctatctcaaaggttccttcatttccggattgattcttgcagcctgtcaatacgcaaatcaacagggccatcagaattgttacgatcttcattgagtaattcatgataaaaattaagtttataactgttttcggacgataaaagtacataaattaatataggatagaggtataataatcggtcatattagggtaaaaaaggttccttttagctgtttttatatacctttgcggcataattcaagtaaacgttgaacaaaaatgagaaagttaatggtaattccgttggttgctgccggtatggttgcaatgtcgggttgcagtaaatcacctgtgaaggaaactgcaaaagtagacgccatcgatctggctaatctggacacaactgtagcgcccggaactgatttttatcagtatgcctgtggtggatggatagaaaaaaatcctctgaaaccggagtattcacgttttggcacattcgaccaactgcgtgacaataatcaggaacaacttcgttcgcttatcgatgaactgggaagcactccccaggaggccggaagcgtggctcaaaagatcggttccctgtatgaaatgggattggatagtgtgaagctgaacaaggaaggtatggctcctataaaagatcagctggaagccatccaacgactgggaacgaaagccgatgtagccaggatggttgccgttttgcataaggaggggatggccccgttctttgcccttttcgtagatgccgacgaaaagaacagttcgatgaatatcgtacaactctaccaggcgggtatcggcatgggcgaccgcgattattatctgctggatgatgaagcgacaatgaaaatgcgtgatgcttacaagcaatatatcaatcacctgtttacgctgaccggagcatcccccgaacaggcagaagctgctgtaaatgcagtaatgaaggttgaaacgggtatcgctgaaatctctttcagccgtgaagacctgcgtgacagccagaagaattacaacaagatcaagctgagtgagttcaaagccaaaaacaacccgatcgactgggatgtctattttgaaagcatgggtctgatggaaatcgaatacctggatgccaaacaacttccgttctatgacgcattgggagagtttatgaaaaatgtttctatcgacgaacagaaatattaccttgcatttaacctgctcgatgccgctgctccttacctgagtgacgactttgtagcgacgcaatttgacttctacggaaagacaatgtccggaaaacaagaacaacagcctcgctggaaacgttccctgtctactgtgaacggtgctttgggagaagctgtcggccagatgtatgtggctaaatatttcccggcttcttcgaaggaaaagatgctgacactggtaggtaatttgcagaaagcgttatccgaacgtatcgccggccttgaatggatgagcgaagcaacgaaggcaaaggcgcaggaaaaactttctgcctttatcgtaaagatcggttatcctgataaatggcgcgattatagtgcactggaaatcaaagacgattcttactgggcaaacgtatgccgctcgaatatcttcgagatggactatatgctggcacaggccggaaaaccggtcgaccgctctcgttggggaatgactccgcagacagtgaatgcctattataaccctacgacaaacgagatctgtttccccgctgccattttgcaacctcctttcttcaacccggatgcagacgatgcagtaaactatggagctatcggtgtcgtgatcggtcatgaaatgactcacggtttcgacgaccagggacgtaactatgataaagacggtaacctgagcgattggtggactccggaagacgctgctcttttcactgaacgtgccgaccgcttggttcagcagtacgacgatatcatcgtagtagacagcgtacatgccaacggacgttacacattgggtgaaaacattgccgaccagggcggtttgctggtatctcacttggcttacctcaattcgttgaacggaaaaacaccggctccgatagacggtttcactaacgaacaacgtttctacctcggatatgcaaccctttggggacagaacatccgtccggaagaaatcctgcgcctgacaaagatcgacccgcattcattgggtaaatggcgtgtcaatgccgccctccgcaatatcgacacattctataccgctttcgatatcaaagaaggcgatccgatgtacatgatgcctgccgaccgggtggtgatttggtaatacaggaatacagatagtataatgtataaagcgggatagtcgttacgattatcccgcttttttatacctgaaatagttgttcaggcaaatataaattttaaaaggaacagggcagccagtatatacatggtaatacttatatccctatgtttaccacagaacatcttgaccagtacatagcaaagtaatcccagtaccatcccgtctgcgatagagtaggtgagtaccatcatgataatggtaatgaaagccgggagtgcttcggatatatcatccatgtcgatctttgataccgagtccatcataaacaccccgacaagcactaaagccccgcttgttgccgcactgggaataagcaggaacaacggagcaaagaacaaagccaggataaacagcagtcctgttaccagggaagtaaagccggaacgccctccttcagcaatgcccgaagcactttccacatacgtggtaatggtcgagctgcccatcatcgccccgatcgtagtacctatcgcgtcagacatcatcgcctctttcacatgcggaatatgcccgtctttccccatgataccggttttggaggccaagcccaccagtgtccctaccgtatcgaatatattcataaataataaggtgaaaatcacgactgccatatccaaagtaaagaactcggtgaaatcgaatttgcagaaagtcggctctatcgaatgaggcatggagactggaagaaaaccttccggtatttccgttactcccagcggtatcccggccaacgtacaaatcaggatactgtaaaataaagcacccttcaccttctttacaaccaggattccgctcagtaggatacccgccattgccaggacggaagacggcgtgaactccccgaacataacgaacgttgccgggttcggggcaatgatcccagcgttttttaacccaatgaaagcgataaacataccgatcccggccgagatggcatatcgcaggttcatcgggatgctgttgagaataatctcccggatgttcaggaaagtgatcaggataaatatcaccccttcgacaaacattgccgtcattgctgtttgccaggagtaccccattccctgcaccagggtaaaagcgaaaaaggcatttaacgccatactcggtgcttgggcaaacggaagtttggccataaatgccagcaaaaaagtcgcaatagcggaagccagtgccgttgctgtgaagacagcccccttgtccattccggtagtgcccaggatagaagggttgacggctagtatataactcattgtcaggaaggtcgttattcctgcgatcacttccgttcggattgtcatggtctgtttgtcaaaccccaatagtttttgtatcatatattttggattaatcgaatgtccactttattgccagcgtcggaatggtataaaaaccgttgcggccaccgaagttatgactcagttccacttcacttccgacactcagcttgaacttatcatcaacacctttcagcttgtttaaattcacccatatctgtggttcggaaaggaaaatgaagttcccgtgatcgtttttctcccgccaccagtcggcaaacccgctgaatgtgcacaatccgtttttagcaaaatgaatataccaggtacctgtcaattggaaattgttcgggctgcggtgtttctggatatatttgtacatgggagtaaaagtaaatcctttggagaagtccttattattatatgtataggtgaaaccaccgaggtaagcgttattataagaagcccccttcatcagtcccccgttatattctatatgtatggagaagggtggttgccagaatttcagttcacgggcgatttcccaataggccgaagcgacgccctcttttttataatccatatctacaaagaagtaagtgcttccccatttatcgaccctgaacatttcgacggtagaggtcagagccggacggccgtcgaggtctttgtcataaagagctccgccaaaatcataatgtaactggatattttgcgctttcccgcatagagtagtggccagtaggataatggccagagtaaagatctttttcataccgatcgtttcatatggtttattgttaggaaagccgcaaagatataaaaaaagcaggacttcccagaaggtcctgccttgtattatcttatatcaaatcacgtagtaaccatgccaggtaacacaggtagataacaagtaagacccacccttcggcccgcgatatcttttgtccggtttttacaaccggcaataggatcactgttagaccgagcatgaccagcaggtcgatatagtttacgtttttggctacgatcggattgattatcgaacttgttcccgctattgcaaggatattgaacaaattcgaccctacgatattaccgatcgcaatatcctggtttttcttcagggcggcaacgacagaggtggccaattccggcaggcttgtccctgcggcaaccaacgtaaggccgataacagcctcgctaactcccagttcctgtgctatcgatacggcattgtcgaccattaaatgagaagcaaagataaggattaccagtccgccgaggatatacaacacatccttataccagggatcaggttgtttttccagttcacctttgttttcttccacctttttctcatacttgcgcgagtaatagaggctaaaagccgtataaataatgataccggcaaggaatagagatccttccaggcggtttaaagtgccgttccagaaaagaacagtaagtaaaacggtcgacaggattaaaagaggaatatctattctggtcaattggcgtttggcttgcagaggatggatgatggcagagataccgagaatgacggcgatattgaatatgttcgaccccacaatattaccgatggcaatatctccctgtccggttaaagaggcgttaatactgacaaccagttccggagcactggtaccgaatgctacaatggtaagccctatgaccagattcgatacatttgcttttagggcgatctccgcacttccccttactaaccagcctgccccgatataaagggcaaacaatgaaagaactaataatgttacacttgttatcatggctgcaaatttactaatctttttattacaatgtccggcttcctgctgcccgacaatcgtgagattgccgtagccaagtaaacagcaagttattttttaggcagaaaaacgtacctcggataaccccaggaatcgctccggagtaacaacaggaagcatatcagacatttcagttagggttgttaggaatattcgtattagtgatttaatattcgtattcttcttttggctgtttagcatctatacgcatctgtataccgcgcagcacaaccataataactgtaatcagtccgagaatccccattgttacatcctttgcaacaatattctcaaaatccgtagtaccgatcagtactaaaatgataaacgacaacatcatggttgcatctactaaatctttatttatcttcattttattaactttttaattatgattattgttcaaattaggtattattctttttcgtcgatagcggcttcttccgtagaacccgagccgctcagtcccttcattataccatataatccataacccagagctcccattacaacgagcaacttcagataatcgttaggtataatcgagctacaagccaatacacaaccaacaatagttataataacagaaagataaatacgactcttatttgattttttagttgacataatactttgatttttaaatggataaatataaaattgctttttcggactgtttcgtagtagccgatagtaactctctatcccctcttgagagggggcagggggtgtgtgaaattacgttactcccgtcgctctataagccgaacggtctaaatacgattagacggagttatcccataaaaatcaaataataagcttccgcaggacaaacacatgttgtgccatacggcaaagaagagtggaaagatttatggtttgacattctgatacatctagtgagattttgcgtaacgtattcatttctttcaggcggatatcctgaagaaccttttctgctattttcagcgtacgcaaatttaatgtattattagtcgattgaaccgttctgcgtgcagtgagtccattgcttcccttcaagtccgtacttaacacggtcaggaagtattgcatatccgcagaacctttttccttcataatagcctcctttttcaacacaacgatatcgttgctctctgtctcctcctgaggagaaaaaagcaaaatgccgaaaagcagagtcagtatgaacaaaatatttttcatgccgcaaagatatacgaattcttatgaaaaaaacaaatgattgtgctttttgtttatacttttgtccgttaattgtgaacgcgaagaaatgaaagaagagaagaaccttttgaaatcatggttggaagccgcccgccccaagacgctgccggcatcattgagtccggtgttattagcttgtgttttagcctggtgtgaaggcgtatttaggttaatacccgctattttgtgttttggagtcgctttgctggcacaaatagccagtaattttgccaacgattactttgattttaagaaaggagccgacaaggaagaccgtctggggccggaacgggcagtagcccagggatggattacccccaaggctatgttgcaggctaccttccttacattagctctgtcgtgcctgtgtggctgcatgcttctgttctatgccggctgggaactgatacccgtcgggatcgctatcgccctttgcgtattggcttattctgccggaccctttccattggcttataacgggttgggggatgtctgcgtggtgttgttctatggcattatcccggtatgcttcacctattatgtgcaggcgctctcattctcgaccctgtcctttctactgtccttgtcggtcggattactttctacgaatatcctggtcgtgaataattaccgcgactatgtacaagataaagccgcacataaacggactacgatcgtgcttttcggtcgtggcttcggtcgtatcttctacctgttgaacggtgttgttgcgcttttgctcgccatgcccctgatattcgatgccccttggtggatactgtttcttttcggagcttttttcaccctcttttatactacttggcgcgaactttaccgctttgaaggccgcgaactcaaccggacactggcccataccgcccgcaatgtctttttcttcaccctcttattgtctgtactgctaatcgcattaacgacaggtttatagctgcaacttcctgtgtcgtatatttgttcatttgaatcattaaatgaataagtatgacacagaatgttttcgattacatgacaacgttggtcgttcgtaaacgaaaggccggcaaggaaagtacagccgatctttaccgggccgtatgcaaccgcctgcactcttttatgcaagggaaaaccttgtattttagagggattaccggagaattggtcaatgaatttgccgggtggctgcgtagcggaggacttgccgtgaataccgtcaacagctacctgagcagcctgcgtgccatctaccatgccgccctgcgcgaagagttgtttaagacggatagagacccgttcttcaacctgcatctgcggcgggaagagacgccgaaacgggcacttaaagccgatgttatccatgaaatgatgcaggtcgacctgtccggatcgttgcccccaccgctttgccctcgatctttttatcttttctttcctcgcctgcggtatgccttttatcgacctcgcttacctgacacgtaagaacatcgtgggaaatgaaatcgtctaccaccggcataagacgggaacactggtacgggtaggcataaccggagcgatgcgtatattattggcgaggtacgagcgaaaaggctcgaactatctgttccccatcctgaaagaagggaaagattcgcattctgcctataaggcggctttgtttacctacaatacattgttgaaagagattggcgaactgcttcacctgcctggaaaactcacttcgtatgtggcgcgccattcgtgggcaacggaagctctccggcaaaataccccggtggctgtcatctgccaggcattggggcatacatctgagaagacaacccgtatctatctggaccaacttgaccagtcaacgttgaatgaggcaaatgaaaagattacgaaagaaattagtgaactggttctgagaagtgcctgagataccttatttacgaaataaggtttgtcggtggtcgtattattcttaaagttcaagcaaagattgtttatcaaagcgtcttgtgaggacaaagataaagaataaaacttaagaatgctcaaatattatctcttttctgggatatgaatttatcccggcttatttgtcatgcccttatatgatgtagctataaccttttttatagtttaaacaggttgttttgctaaaatatattaacggaggtgaattttgaatataccgctccgggatgccagtggaattaacatccttttaggaattacttggataaaatgtagccttatattggctgtttagtgcatctgagagtatctaaactcccctcttgagagggggtagggggtgtgtcacctgcttaccgtcatgacagacttaatctatccaactatcctgattactgtcttttgacttagtatgaaatagcaatcaaggccattgtataacagtggtttaggaatcttctttgtcttccgggtatgaatataacacaccccctgccccctctcaagaggggaaaggttactcccgacactataaaaaaataggatatagttcctgctttcccccaacatgtcaaatccgttccgatcccgcaagggatagcgttctttgacatgttggggtttagaataaatattactatatttgtaagtctaaaattgatgttttatgaaacgtcctgaaatagtaaaagcaataaagaaagtattgaaacaggtagctcccgatgctactgcaatactttatggcagtgaagcacgtggtgacgcacgtcctgatagcgatattgatttgctgatactggtagacaaggaacgtatttcattagaagacgaaatgcgtatcatggaaccaatatatgagatcgaacttcagtccggtgttcaaatcaatccttttttcgaaacactaaagaaatggggtaagcgcattactcctttttatctgaatgtaatgaaggaaggagtcgctttatgaacgacgaacttagaaaagagattattctgtatcgtatggagtccgccgaagcattactaaaggaaatagatagccatatcaataatggtttttataatacggctgtcaaccggatgtattatgcttgcttttactccgtaagtgctttattacttcatcatctggtagatggtgttaaaacacatgaaggtatccgacaaatgttcggaaagcacttcatcaccacaggtctattacctaaagattttgggaagttttatacaattctgtttgcaagacgaagtgcagccgattatgaagattttttgaactatgacgaacaatctgccagggaattgcaacctcaaacaaaagtctttataaaagctatacatgatctgataaataagtaatatcttatcaaacttttcccccaacatgtcaatttcgttccgatcccgcaagggatagcgttctttgacatgttggggtttagaagaaaaaatagtgggtccaataggataatgtgccaattgtttttgaaagaatggagggatttgctttgtatttagtattaatattcttatttttgtgacatcaaaatcagaatacttatggcactaacaattagagcaattcccactctcacgggacaagcggctatcgatttcgaaaagaaagcgagggaggccgagaaaaaacgaggttctgtcgatttctccgaacaaaaaaagatagcgaaagagattttggcaaaagtaaagttataacaacatttaaaacttgactatgaaaatggaattcctgaataataactgttttttctctgtattgaatgcagaaaccttatcggatgcagcctcttttggctgtggagatacttctacctaatgcacgaagaaagagagtagcacgaaatattccgcatataaaagaacataaaagttatcctgctgtattaatcggacgtttgggagtaaatgtaaactttcaatcgcatcatattggttgcgaattgatggattttataaaatcttggtttgttgatctgcttaataaaatgggatgtcgttttattgttgttgatgcttacaacaatgaaaaaacaatagcttattataaaaagaataattttgaactggtctttagctcagaagatcaggaagccggtatattaagccatgtcgatgaaaagctgaatacaagattcatgttttttgatctgataactgtttgttgaataaaaatacatttcttctaaacccctcatcatctgaacgaacagatgttgggggatttttattttcccccgacagctagtattaattattaaaaacaaaagaattatgtctgacataaaattatatgccgatctgtatgataacgcattaacagaaaaattgggcgattgcgtagcacgcccacgtattaacggtacactttacaatgccgatattgcccggcgcattgtcgagaaaagaacggggtatcgtgccgaaaccatcgagaacatcctgcgtatggccgacgatgaaaaatcgttggggatagccagcgggatgagtgtggtagatggggtagggcagtaccttccccagatcaaaggtgtatttgccaagccgaccgacccgttcgacccggagaaacattcacttgttgtagcctatactaccggtaagatcttgcgtaaacgactgctggaaaccgaggtagtgacaaacggtgccgctatcgtaggcccggtgatcggtggtatcaccgactcgtctaccggcaaagatgacggaacttttactcccggtatgccgatcgttgtggatggcagcaatatcaagatcacaggcgcgaacgaggccaacggcttctatttcatcccggcagccgtgggtggcacgccggtgaaggtcactgtgattgttcataataatccttcgcaactgaccctgatggtgccggctgatcttccggcaggcgattattatgccagcatcaccactcagtacggacgtacggccaacgtaaaagacccccgcacatataagtacccgatcctgctaagtactgccggaaggggtggagacgacgaccgtccggtgatcgagtaaaatacccgaatgtttctccgtcccgggtcggaggcctcttccgtctcccgttggacatcagttccgacccgggacggacaccgcttccgtcgggagacggacgaacattcggtaattctgtttttacaactaaataataagagaaatgaaataaatgaaactaatatactggatatccgtttttcttctgccgctcctgttcctctactcttgtgatgaagaagagatcggcaaaaagaaccaaccgctgcccgacggtgtgatgcgcctttcggcaacggtacgcaatgggttgaagacccgtgcattgaatgatccgctgagtgatgctaccgtcgatgagaaacgggtagaccgcatcgccttctttgtccataccgaagccgaaggcatgcaggtctatccaccggctacaccggcttctgtttatcctgatgaacctaacaaggtgcatttgaccgataacggcgacggaacttacagtgccaatgtagacctgacggccggtgcgggttacgatgccgatgtgattgccgtagccaacctgccggaagcgtatgattacacgcagatagtcagctggaaaggtttactcgacagcgtgacggttgcgaccacggcgatgccgctctgcacgggtgagtatgacacgggcaaaaagaatgcctttgttatgtttgcctctgctaccgttgccttgcacaaagaaaaagaggcggctgtcaattttgcgatggagcgtctggtggcacgtatcgacatcaccaataaggcgtatggtacgggaaagaatgcctttaagctgactaaagcccgtatcctgcaagccaaaccggccagctacatcacgccgcacgacctttatgcctctccggaagtgctgacggtgaacgactgggaactcgatccggcagcggtcaaattctacaaaggggaagtgaataccgccaacgaaacgacggaagccgccggtgatgccgtctgccaggtagcctagcagaccctctacacctacgagaatgatgatgtggcgcataccccgacttgcctggaagtgaccggcgaaatgaatggggcaacgatcacccgtaagattcctttcgaagtgacggatgccgacggtatcactaaaaatcctgtccctatcgtccgcaaccatcgttacctggtacagattaatccggctcccgctgaaacggatatcacctacaagctgacggtggacgaatggaacgccgtggatacggtgaatgtgcagccgaaccagaatcaggtgccggtaataagtaattattcctgtgccgaggcgacgaagactttcggcactttcgatgcttcaacgggtatgcccgacacaattgtcgttccggctaccggggggatgatcggtttcaccgcctcttgtccgttcgacagccgcgtgatcgtggattatgcctccgctgctgatggtaacggctggctggaaataattgatcgttcggatgcggtggtgacaaaagcgggaagcagcctgtcccgtacatataaaatcaccgtcaaagccgatctggctcttgatccaacgcaggtgaaccggggggctctctatattgtgaatggtggaaatggctcggtgatggatacggttacggtttatcagggggctgatatcgcttatgcggatacccggtttgctgcagttacggcttatggtgctgtctgggctccgtataatagtggggcaacggaggtggtcggtaaagatgagacgattacagtatggacactggaaaagtgcggttatttgtatcagtggggccgtaatgtaccgtttgtttacgatggactatccagtgctctttacacaggggatttatcggcattgaataaatatccgaattataatgatgcctgcaggaatgaaggtgtatatgcagataaattcattacaggttttgccgatgcaggtaatacttggtttaaagattacaagaccggaggagtaactgcgggggataatgcatggttacgtgaaaatcagccttgtcctgtaggttggcgtgtcccgacgcaagctgaattggaaaaaattttggtcgacacccccaaagtctctgatggaaaatgggtatcaccgtctaataacagcttcatcctgatagcgggagggtattggaatttcagtgggacttcgagtacccctgttgcagaaggggattattgggcctcttcttttacaacgagtgagggtgcggcttcacgtctgatgttgagaagtgatcgtgcccttgtggatatccgaacaccggcttacgctttttctgtccgttgcgtaaaaaacgaacctttcccctctccgagagggggcagggggtgtgtgaatttatcgtataaggccgcaaggccaatgttctttgacatggtgggggattaaatataaatgacacagtgaagttgttattgaaatttgttatctttgtgattgtttctaatgtatataattatgaagtctacaggcgaatatttggcaatcctgcgatcatttatgcaaaaacatgcggaaaagtatggcatattatctatgggtatattcggttcggtagcacgtggcgaacaacgggcagacagtgatctcgatgtctttgttgagttgcgcgaggccgacccttttatcatgggaaatatcagtgacgatctggaagctctttgtggttgcaaaatagacttgttgcgtcttcgaaacggattaaataaactattattaaaaagaatagaacaagatggaatcccagcttaaagaagaagttatcaatcgattggaacaaatcgtcgaatcgatagatgtcttgcttgaaaggaataaggagataacttctgtagaagattatttgtccactccctggggtatgacacttctggatgcaaacctgatgcgtattcagtttattggcgaaacagcttcggctatagacaagaaaaccgataaattgttattggtcaattatccggagataccctggaaacaaatatttggtatgagaaattatatttctcaccaatatgcggatattgacccggatatggttttggtggttgttagaaaacatttgaaaccgttgaaagtgactgtacaacaaataattcaaaatttggaataagttatcattttatattgaatcccccgccagtaatctctgccgggggattttttattctcttagccttcgacagtttataaaaaacaagggaatataaaaaatgaactgataaacttatgaaacattatctatatatgtcggccttattgttagccggctttttcctcggtagttgtaccgaggataagattagcggaggagaaccgcctgttctgacaggcgatgccgctatgctgaaagtctctttccgcaacggaacggttacccgtgccctcggtgacccgtttgcagccaccgacgcagaaaagacaatcaccaaactctctttttatgtctaccctgaaaaggaggctgataaagagttcgttccttttcagcgctatgtgttcgatatgacgacactcccactggaaaaagacagtgtgaagatcacggaaacggctaaaggtgaatacgactgtgactttatcctgcttgaaggcggtggtttcagttgccggatcgtcgccctggccaacttgccggacgatttcgacgagacaaacaacctgaatacttacgctaaattgcaggaagctgttttgcagactgatattatgccgacagtcgcttctgctgatccgaaggttgataatcaatatggcctggtgatgtatgcagaagatgcgaagatgatcaaaaagtcggtagagacggggatggctttcactatgcaacgcttggccgcccgtatcgatataacgaaccgggctttcgatcaggatttcccggaaaaagggtttgtcctgacctctgcccatatagtcaatgccaaaccgggcagttacctgatcccggctgcaactactgcttctttactgacccgtaattttgcggaagtgaatgacccggctaagataataggctacagtcaggacggtacggattataagagtccgacaccgggaacgagcgatataaatggaaatacaatcggggtggatgcctcgatagaagcaggtgttgtagaacaacgtctctggcacgagctctacacctatgagaatgacgacgaggatgccggttcggctacctcggtactaatcaaaggtaagtttcgcgactcaccgttcagccgtgtgattccgtttgtgaacagtaaaggcgccccggttattatcgaacgtaaccatcgttacctgatccgtatcaatccggctcccgatatgacggatgtctctttcaatatccaggtaacggattggaatgccgtcgacactgtcaacgtgaaaccgacgcagaaggtggtacccgaattgggtaatttttccgccgattttattccggataccgataataagattgccctgcctgccgctaccggcactttcacgttcgaagcagtgaatcctttcgatacggattgtgtgatcgtacccgaacccgatgatgaggatgccgccgccggtgacgaacattatctggagtggatcagcgtttcggcttccgatccgacgatcgtgacaaaagcatctaccggctacaaaagaacttataccgtccaggtggacgaattatcggatgcaggtacccgccgctccatgttgttgatccgtaataaagcgaatgtgacagcccgtgatacgttgcacatcagtcaaacgaaggatgcggtgactccttagtggagctttgaaataatggaaacaacatcttactaccaacaataaataatgaataaaacagacttgataaaacatgtagctgcccataccggaaatacggagtgttgctgtcgtcggatggtggatgctgtattggatgctatggcggaggggctaagcgacggggaaggaataaccctgcagggttttggctcttttcgtccgtgggcacaaagtcagcgactgggacggaatccccgcacgggagaaagctgccagataacttcccggacgagcgttaagttcagagccggtaaggagttattgaaagtaatgaacaagcaaaaataataatcaatgcttggaataatgtaataaggccctgcggacaccccgcagggttttttgtatggttttggataagatgatcattgttacggctatgattataagcagaatgccgacggccagattgaaagtgaacggttctccgaataccaatacaccgacaaatacggccgttacaggttccatagctcccagcacggcagtgagtgtgccacctatattatgcacagccaatacgagcgttatgttggatatcactgtcggtacgatagccagcaggatcaggttgacaaccgacatggcatcgggaatgggttgtatcccctcattcgtgcttgctttgatggcaaacaggaaggtactgacaatgaatacgtagaacgtcagtttcctgcctgtcatattgtgtatccgcgatttattgacggtcgtgatataaagggcatacccgacagccgaaagcagtacgataaagacacccagtacgctcaatttcatttccccttcgttgatagacaggcgggcaactccacagatcgccaggcagatcgccagcaacgtgacccatgatgttttttcgcggaaaaacaccagcatgataagggtgacgaatatcggataggtgaaatgcaacgttgtagctatccccgccgacatgaagttatatccccagaaaaggaacatggcggatgccgtgtaaaagaagccgagcaatatcagtacgggaatgtcttttttgtcgatatgcatggattcctttttcaccgccatgatgccgataagggctatcgatgcaaaaaggaaacggtagaacaggatcgaatcgaactgcatcccctttgccataagcggcaaagtaaacaatggtatcaaaccgaatgtagccgaagtggcaatgccgtatgcgaatcctttcaaattgttgttcatctttttcctttttaccttttgctaaaacggctgcaaacatacaaaaaagccgcgatattatcaggtaatatcacggctcttaaatattatttcagatgattaaaccaacagaccggcggcaacttcttcggctacagcctgacttttgatagcagctaccagggcaagaccgaagttaatgatcagtccaggacctttgccggtaatcacgttgtcggaaacttcaacagcttcaccagtcacattagctccgatcagtttcggttcgaagcccggatagcaggtagcgttacggcctttcagcaatcctagtccgcctagtaccatcggagctgcacagatggcggcaacgatctttccttcacggtattgctgcaacagggcttcttttaccggctccgaatcattcaggttggctgctccgggcataccaccgggcagaacaagcgcatcggttcctgccaggtctgcttttcccagcgttgtatcagcagtaaccggaacattatgtgctcccgttacaacaggattgtctgtgatggaaacagttgtcacttcgatacctccgcggcgcaggatatcgactgtgcccagggcttccatttcttcgaagccattggctaaaaatacaattgctttcttcatattacttccgttatttaagtttatacacataggtgatcgtaccgctttggttgttcgccccgttgatgctgttgaatttagcacgtttggcggcatccagtgcactcttacgcatggaagcgttgtcgatgttggtacctcttcctatttctgtgaatattacattgcctttcggatctaccgtaatgttgatcacgattttgccttcttcctggatcgtgtaagcggggcggggcaagcctccggctccgatagaacgaccgttcaggttgaatgaaccgtaaccgcctacgccttcgttggctccgtggtcggagttgccgaacggacttccctggttacccgtacctgtttctgcatcgccctggctgttcccttcagcgccgccgataccgaatgctccggcaacacgattgctgatggcctgctctttcttgcgacgttcttcttccaaacgtttcttttcggcctcttcccgtttgcggcgatcctcttcctctttccgtttacgctcttcttcctttttgcgttgctcttctttctttttagcgtctgctatggcaacactctcttcgatgtcctgcgtgatcacttcctctttcggtgtttctaccggtggagtgggtggcggtggaggagtggtcgtctcctggggtagttcctgtccggtgtatttgggttcgaaggtaccggcggcggagtttacattcccgaagttgacaaggacacccccgtcttcatccggaatttccgtacgtagtaccgtgaacaacaggatcaggaagatcgccaggtgaaatgcgaccgaaccggttatactgtatatgtcatctttgttgaatttcatatctgttatttctgcgcacgggtggcaagcaccatcttgaatttgttttcgttcgctatgttcaggatctttacgatttctttataaggaactgtctcgtctgcataaagggcgacgaacatttcgggctcttttgcgtaactgtcttgcaggaacggggtgatctcgtcgaacgtgacctgcgtttcccgctggttaccgaatgctacgtagtaattcaggttggcatcgatggtaacccgcgtgagcggtttggctgccgtttgcttcttcgcctgcggcaatgttaccttgatggcattcggaatgactaccgtagaggtgaccataaagaagatcaacagcaggaatatgacgtcggtcatggaggccatgctgaaggcttcgtttacttttgttcttcgttttagtgccattcgctttgttaattagccggttcgttcaataaatccataaattccatggtgcgggcttccatcttgttcaccacgttgtcgacttgtgaaaccaggtagttgtaagcaaacagggtgatgataccgactaccagaccgccgacggtggttacaagtgcttcgtaaatacctccggacaataaggatacgtcaacgttcgttccggcattcgccatatcgaagaaggcgcgtaccataccggttaccgttccgaggaaacccaacataggagctccggcagctgtcgtagcgatcagcgggaagcctttttccagtttcgcaatttccaggttacccacgttttcgatagcaacgagtacatcgttcatcggacgtcccagacgtgtgatacccttttcgatcatacgggcggaaggggtgttggtgctgcggcacaggttcagtgccgagtcgactttcccttcatggatatagtctttgatacggttcatgaaattctgatcttctttacccgcacggcggataactaataaacgctggatgaagatgtagcctgccattagtgataacagcaataatacaaccatgatccaccctcctttgaatgcaaggtctattacattgatctctgcttcagtggggactgttactgccgtcagatccggcatctgctctgctgtctgtgcccctactgcctgtagggaaagtaaaatactcatagatttgtatacttattcgttaatattagtttgttcttattgttgcaagcatgctttatataatgaaatggtctcctgcaatccgtgatacaacgcgtcgcagatcagggcatgaccgatggaaacctcttccagccaaggtatgttctgactgaaccacgccaggttttccaggctcaggtcgtggccggcattgactcccattcccagattctttgccagttgtgcggcagcaacgaaaggagcgacggcttcttccttgtttaccgggtaattggttgcataaggctctgtgtacagctcgatgcggtcggtacctgtttttgccgccagttcgatgttggccaggtcggtccctacgaagatagaggtgcggattccctgtgcggtgaacgtatcgaccagttcactcagcaggtcgaagtttgcctttacatcccagccggcattggaggtgatggcatcgggtgcatccggaaccagtgtcacctgtgtcggttttacttttaataccaggtctataaaattgttacaaggatacccttcaatgttaaattctgtcctgataagaggttttaacgcgtacacgtcactgtatttgatatgtcgttcgtccggacgtggatggactgtaattccttgtgcaccgaaattttcgcaatcttgagctacttttaaaatgtcaggcatgttacctccgcgtgcgttacggatggttgcaaccttgttaatgtttacacttaaatttgtcatcgtatatcgttatatcttttttctttcattacatttgcacaaaagtatcggcaaatttagcagaattaagggaattaacagaataatgttggtgaaagatttcataacgaaggaacttcccgtgttaaaaagttttgacacaggggaatacgcgttggcattgatggatgattttaagttaaaacatctgcctttgttgagcgaggggatataccgttgcctgatctcggaaaaggatctgatggctatgcctgatcctgaggcaacgattggcgagccggttctgtttgctcccagtgcgatggagaatacgcatatccatgaggcgctttcgctgatcgcccgctaccagttgagcctgctgccggtggtcagtccggaaggggagtatcggggggcgattacgagagagaaactgatcgatattctttcagagctgtgtaatgccgagacttcgggcagtgtgtttgttctggaggtgatgccgcaggattattcgctgacggatattgcccgtttgatcgaatcgaacaatgcgcatgtattgaatctgctttcgtacacggataaagataccggaaggttacatcttattattaaaatcgatctggaggatgcttcgccggtgatccgtagtttcgagcgtttcaattatactgttctttattatttcatggaaaaagggatggtggatgatctgttgcagcagcggatgaacgagttgttgcattatatgaatatttaatcaattgacagttttatgaaggttggtgtatttggcagtgaatatcaggtagagaaacagagtcagataaaacgtttgtttgaaaagcttcgtttgcaggaggcggaggtgtatgtggactctcaattctactacttcctgacagatgtcctgaatttcgcacctgtagtggccgggttgctgacagatgatgatttcgatctggatgtggctctcagtgtgggaggtgacggtactttcctgcgtacggcagcccgggtgaatcggcaggatattcctattctgggtattaataccggacggctcggttttctggcagatgtgggtggtaatgatatcgaggacacgttggatgagttattcaagaactattataaaatagaagaacgtactttattgcgtctgaatacggaagaccgtgtttttaaggggtataactatgcgttgaatgagatcgccatattgaagcgcgacacctcttcaatgatcacgatccatacgtcgcttaatgatgagtacctggcttcataccaggcagatggattgctgatcgcaacgccgaccggttcgacagcttattccatgagtgtgaacggaccgatcattataccgcaaagtaacaatatcgtattgagtcccgttgcccctcattccctgaatgttcgccctctggttattcctgatacttataagatcacgctaggggtcgagagccggaataaatatttcctgatctcattggacggacgttcggaaatattccctaccggtatacaactgacggtatcgaaagcagattatacaacaaaagtgattaaaagatataatcataccttttatcagacgcttcgtgagaaactcatgtggggcgcagacgcaaggatgaaatagaggattgtagctgaattatgctgcaaaaagatgttttatagcatgtatttgttaaatcatattaaagatgtgagaaaaacaaatgatatattatgctacataacataaaacctctatatttgtactgtgtttttcatggtattagatttaaggttaacaatgaagattggctgtccgcgatggatggccttttttattttctgccaattggacttttctgaaacaattatttttatatttgcctctgataaaatccacataagtaatttaagtacgattgatattggtcttatcgatgaaggggagatttgctgttatgattacatccagggaagatgagtatgttaaggcgctgagtaacggtgattcgaaagcattcgaattattgtttctgcggtatcagcctaaacttgtctatttctttacaggctttgtacacgatgacgagatcgcgcaggacttagcccaggatcttttttttaatctttggaataacagaagcaagctttcggatatacgtttgtttcaatcttacctttatcagatggcacgtaacatcttatacaattattatgatcattctttggtgcaggaaaaatacgggatggcgcaatttttatctccatcggtatccgatgatccggaagaacagttatttgccagcaacttacaggaattgattaacctcagagtcgatcagatgcctccccaacggagacagatttttcgtatgagccggatggaaggtctgaataatgaggaaattgcaaaccggctcaatataaataaacggactgtggagaaccatttaaccgtcgccctggcggatttgaggaaaatgtttaaaatctttattctgctctttttccattgattatttgttttcgataaaaaatcaatttagactgtgtgtaaaaccgaagttcgctttcttattcataaaaagcgataattatgcacgaaaaagagataagggagataatcaggttattttttagaaaacggttttcgaaggatactcaattacgttttcgttattggtttcgttcggaaggagatcgtgatgaaaaggagcatgccctgcaggaaatctgggagacaagtccgtctgatatttcagagcagacctggaacaggctgtcggaaattcaggacaggatttcaaagtcagggaatgtgacattaccggagagacgcaacaggcgctggttgaaatatgtagcagtagccgctgtttggatactgacagtgttcacaacccgttatttctctgaacaggatgttaaaatagtatctccgaaactaactgaattttatgtcccttatggtgataagcaggagataacgttatccgatggctctgttgtgtgggtaaatgccgggtcagtccttatttatccttcggagtttactgctgccacacgtaccgtttttcttagtggggaagcttgtttcaaggtggcgaaaaatccagaacagccgttcattgtaagtacgaaacatctggatgttcaagctttgggtactgtttttagtgtaaatgcttatcccggttcaacagaaactattgcaacgttggaggaaggaagtatacaggtggatacgaaatcttcgatgactctggcttccattttaaagcccaatgaacaatttgtctactcccatttgacacaccaggcgacaatcaatgtggtggatgctgaacaagtctcggcctggaaagatggttacctgatattcaaaaatgccagctttgaagaagtgactgccgctttggaacgcaaatataatgtgacaattaattataatgcggaaaaatataaggggcgtacctattatgtgaaattcaatccggatgaaagtatagaagatgctcttctgattttaaaacatttgatagaagacttcagataccggataacagggcaaacaatcagtataaactaaaaggaaggaggaaccacagcatatataaaagaaagacggggagaacgaccggcaaaatctcctccccgtattttgaaatcatagaataccatcaaaaacatttcaagaaatattaaaatagtattcatattaataataacacacaaagatatgcgaattacctttctaatacaatcagaaaagactaaaatcttttcatgtatattaataacattcctattgttggcttttgtgccattggtagaagcacagaatcaaaaggttcatctgaccggaacggataattccctccgtactgcttttgagcagatagagaaacaaacaaagatgtcagtagattatgatgcgaaaatacttgatacttcgcgtccggctcctgcaacttcgggggaaacaactgtcggcgatctgatgaaagtgttgttgcaaaactccggttgtactttcacaatacagggatcacatatccttatttcgagacagctggttgctgaaagcaaaaataaggtaaccggatcgataaccgatgaaaggggagaacctgtaatcggagcatccgtattggaaaaaggaacaaccaatggaactataacagatctggatggtaaatttgcattggaagtatcttccggtgcagtcttgtcagtcagttttgttggctaccagactctttccgttaatgttgaggggagaagaaatgtcaatatcactctgaaagaagatatggaacagctggaagaagtggtcgttgtcggttatggtacacagaagaaatccagtttaacagcctctgttgctactgttcctgcccaggagttgaacaaacaagtgggacactcggtagcatccgccttgcaaggacgtactcctggtgtggaagtcttgcaaaaaggaggagaagcaggtgctgatataaagatacttgtgcgcggagctggtacattcggtgctacggagcctctgtatgtcattgacggtgcattctcaaacaatggccttaactcgctgaatccgtcggatatcgagtcgatggaaatattgaaggatggttctgctgctgccatttatggttcacgggctgcgaacggtgtagttctgatcacaacgaaacatggtcagaaggggaaggcgaaagtggagatatccgcaaactactctatgcaaacaccttccaaatacctggatttcctgggtgcaaacgaacatcgtgaatatacaaagcagcttgtcgctaattccagtaatcagacccaggcaccggaaaatgtaaatccgactaatccgggtatcaatacggactggcaggatgcttatttaagaaactcacctatgtataatctgaatgcggctatttccggtggcggtgaatattcgactttcaataccagtatcggttatttcgatcagcaaggtattatggagttctccggtttcaagaagtacaatgcacgtgtgaacggaactttcaagaaaggccgtctgactgtcagtgaaacactttctgccgcattcacgaataaagaaccacaagtaagaatggtcatgggaattccgaccgtgccgatgacagatgccgaaggacgatatgtttcggcaggcagggagttttacgtgaacgaaagtaaggtgacgaatcctttcgcttcttattccaataccgtcagaagaaataagacagtcaatgtaacaggtagcttaaacataggattgaacttgtttaaggggctggactataagcttgtactgggtggtgattatatttccacaaataattattcccgctccattgcattcgattccaactgggatgccaatggtgacccagatccggattacagccgaacgctcaactccctgtcagaaagccgggggcagcgattcaactatacgatcgataatatattgacttataagaatacttttgaaggccatactttcgacgcaatgataggtaccagctggatgcgtgaatattacagaacaatgggaattggttcgggttctacggatctgggaggccccagtattactatctataatggaaaaggagatataaccagcgaggaatataattcggctttactttcatttttcgcccggttaaactatgactacaaagactgctatcttgtttctgcaagtatccgtagtgataagtcttcaaaatttgccaaaggaaaccgggtagggtatttcccttctgtctctatcggatggaatatacatgaagaagaattctttaatatcgattggatcagcagaatgaaaattagagccagctatggagaattaggggcaaactttattgatccttattcattcctttccacggcatacggccctattccatcagtgttcggtgaaaatcaaaccgggcaggaaagtgtgatgaacggttacgttactaaatttgctcaggagaacctgacgtgggagaaatccatctctaaaaacatcgcattagaaatggcatttctgaataatcaattatcattcacggctgaatatttctggaaagataacaatgacctgcttgctccgttgctgcctttggcttcatccgggcagaccattatgaccaatggcggtgatttaccagttttcaactctgcgtcggtagagaacaaaggctttgaatttacggtaggttatcgcaaagactggaaagactggagcctgggggtaactgccaatatttctgctttgaaaaataatgtaaagagtctgggcgaaggggtacaacctatcaaggcggaagtgatgatgagcggttcattcaacgaccgtcctaccattacgaagccggggcttcctatcggtacattctggggatatgtggtcgatggttttgatgctgacggaaactttattttccaggataataatggtagcgtagatggtgtattgaccggaaaaccggatgggaagatcgatgaaaacgataaaacagctatcggcaatcctcatccggattttacttatgggttgaacatcaatgtcggctataagaactgggatctgaccgctttcttccagggtacgcaaggcaatgacgtctttgctttgatgaagtacgactggtattttggcggtgccaatagtgccattctgaaagatgctttttacaactcgtggactccgcagaatacgaatgcagaggctcctaagctgaatagcaagaatagttcgggtatcaactcgctaccaagtacattttatgtagaagacggttcctatttcagatgcaagaatttacagatcggttattcttttgacaggaagttgttgcagaaactccatgtcgatctggtgcggatttatgcaggtgtgcaaaatctgttcactatcaccaagtatccgctgtatgatccggaagttagttccaacgcgctgttcgacagaggagtggatggcttctggcaggcgcaggagagtccgcatgaagcaacaatgaactccagagtatataatatcggtatcaatttaactttctaaaactcgtatgaatatgaaaaacagtttgcataaaatattaatatgggtcatcggtttcgtaattaccgggatgatgacttcttgtgaagacatttttgacgaattgtctgtcaatccgaatcagttggatgtaaactcattctatactacaccggaaaattgtaacaagggagttttggggatctatggttacatatctactccgcgtaacttgggtgcttgtggcttcgggttgatgctgacccgtagtgatgagggatgttcagtagccgattatggcgtacccggtgcttataacgaggaatttactccctcgtattattctttggtacagccgtttcagttgatgtatacggctgcatcgcaggcgaaccagatgatagaaagtctaactgatcttgaatttagtaataaagaacagcatgatgcttatctgggtgaagcttatttccttcgtgcattcacgcactttttcttattcattaattacaggaacatacctttaatcaaagaattaccaaaagcccctaatgaatataaaccgcaggcaacaccggaagaggcctgggattttatcataggtgatctgattaaagcgaaagacctgcttccgggtaaggattattgggatttaaaaaacaaaggccgtgttaccagggcttcagcttgtgcccttttgggtaaagcttatctgtatcgttcggggatagagcctaaatacggtacttcacaaacgacttattatgatgaggcggcagcagcatttgctgagatcatcaatggaaattgcggcaattaccgactggtagacgactactcgtggaatttcgacgtaactcatgaaaataacgatgagtctatttttgaaatacaatttgtcggtgtgttgaataccggatttaatcctggttttgtggatagcggcctgtttaatgatatccgttgtaaaatgtgtatcatgaataaaaacagaaattcgaatagttctgcacaagtgatgcataattggttatatgacaaatttgttgcctcaaagaccgttgatggaaagactgatccacggatgttcgggtcgtttgtttttaatgataatgctccggaaattattaatccggacggaatgaaagtgactttcctggaaaataaaaactgggaggcagagatgggatccaaagacggtacattcggcgaacaatatgaactggctaccggatataagatgtgtagcagaaagtggatggactggacattgcctccgacggacgatgccggagcccattttttcaatggccgtgcacaaggtgtcaactggagaatgattcgttattcagatgtcttgctgatgtatgccgaagcagtcgttatgggaggtaaagctacagctaatataaccccgttggaagcgatcaatcgtgtacgtgacagagccggtgttccttatattgcagatgcaaatatggaaacgatcgaaaatgaacgtgttctggagcttacttacgaaggatttcgcttttttgatttacttcgttggggaaaagtggtggaacgtttccgtgagttggaagcttccgatcctttgtttaagaagtttagcagagctcagtatatgggtttccaggaaaacaagaatgagtggattccgctgcctatcgatgaagtagaaggtaatccgtatataattaagaataatccaggttggtaattaaaataaagataacatgaaaatagcttattatttgatatgcactgcttttctttcgggttgtgtctcttcgcaaaacaattgtccggtagaaggcaatggcaaaactttgcataatggaatagttcttccggagctttggcctccgggtatggtagatgatggcgtttgccgtgaaatgcctttgccgtatattgaaaacaaaccggctgttatcccgattaatctcggacgccagttgtttgtcgatgattttctcattgcagaaacagatatgcagcgtgtctctcacaaagcaacgttttacgaaggaaatccggtacttgcaccggataaggaatgggaatatacatttgaacgtgccccttatgcagctcctttcagcgatggtatctggtatgatgagactgaccggaaattcaaaatgtggtatctggccggtgcgggatctatgcataaacaccgccagagtttttacacctgttatgccgagtcgcttgacggtaaacagtggcagaaggttaatatggatgtgaaaccggggactaatatagtcgatacttgcgatagggatgctgctacggtatggctggataaaacgtgtccggatccggaaaagcgttttaaacttttcaatgtggagaagcaccggggtggctggaaagtgatcctgaaatactctacagatggtatccactggtcggaaggggtagcacaatccgggccggtaggcgaccgtaccacggctttctataaccctttcactgggaaatgggcactgagtctccggcaaggggctaaagcggacggacgctccaggggatatttggaaaatgaagatccggaaatggctgtcagtgtggcgcattcgttggcggcgggtatcaaagataaaaatatagtcttatggtttactccgtcggataaggaattggtacatccggaatttccggatgtacgtcctgccatctataactttgatgctatgccttatgagagtgttatgttgggattttatgctatgtggaaagggccggagaatgatgtttgcgataaattaggtattcagaagaggaatgagattggaatgggatacagccgcgatggtttccatttttatcgtcctacttatgaacctattatgggtgttaatgaaacggacggggcatggaactggggaaatatgcaatcgattatcggcgtaccgctggttgtaggtgattccctgtatctgtattccagcggaagaatgaaaaacgatgtcatgtgggatggttttacttccacgggtatggcaactttacgtcgtgacgggtttgtttccatgcaaactccggggcagggtttcctcactaccggaaatattaaatttgacggtaagtacttttttgtcaatgcacaggttaaaaacttgcaggtagagatattggatgaaaagggaaaagtaatccccggattttccaaggatgactgtgatgcattgaaggatttaaattcgaccaaacaaatggttacgtggaaatcgggaaaagacctgtcctctcttactgataaagtcgtgaaaataaaattctatgtaactgatggtgatctgtatgctttttggatttctccctggaaaacaggtgaaagccgagggtatacaggaggtggtggccccggcttgaatccggccggaattgataagccattatgatgggaaggatgatttctatatagtaaaatatggtatgtagtatatttcgttaatcatattaaaggtacggtaaatatgctgcataccatgacgcttttgtgtaaagataggctgtccgtgatggatggccttttttgcgttctaccataataactattgttcattatggttctgaaatatgaaatttaattttgaaatatagaattgtattcctacctttgtataaaaataaatagcaatgaggatatttacggaacaggcattaaaagaatatgcagaaaagtatcccgactcaagagtcgctcttcaagaatggacaacgatagtaaaacagagtaagtggactaactatgctgatgtgaagaaaacattcaatagtgtagacaatgttggcaatcagcattatgttttaaatatcaaaggttataattatcgattggtagttgttattaagtttacgatccagttcgtttatattcgtttcatcggtactcataaagaatatgatcaaattgattgttctaaaatttaaggtgtatgacaaagatagaaaatcaggctcaatatgaatgggcagttaaaagggtagaggaacttcttccactagtggatgacaatactccactgaatgatcctaatagcatagaattagagcttttgtctaatcttgtggctgattactcagaagagcattatgctttaggagaaccaactttggtggatgtactaaaacttcgcatgtatgaaatgggacttaatcaaaaatcattatccaaactgataggagtaagtccttcccggctcagtgattatatctctggtaaatgtgaaccgactttgaaagttgccagggaaattaatcggaaactgaatattgatgctaatataatactcggagtataatctatacaccctactcgataagtagaccgacagctacttatcgagtaggtagtatggttacttactaagtaagttgcagtctacttattaagtagattttgccttacttagtaagtagacttagcccttgtttggtagcggatctgcgtttagatagaacgacttttttttattgaaatatcttcaaaaatattttgttatatcataaatgtgggtggacaaatctgcgcgaaaattccatgtcaggttggacagaatactatctcgatgcaggtatatcctgcaggcatttattttatccgtatggataatgaagtggtaaaagtcgtcaaacagtaaagacgtatggtctaatcattccaaacatgctgcaaaaacaatgttttgcagcatgtttttgttaaactatattaagtgaatgagaaaaacaagctaaatgttatgctgtataacataaagcctctatatttgcactgtgtttttcatggtattagatttaaggttaacaatgaagattggctgtccgggatggatagccttttttttgtccgtatatgaactctttatatttcctataacagaattattcttgaatttataatatctgataattgctccttcaatttgttcgcttgtacgggtttagccatatagccgtcaaatccattttccataactcgctgctcatctgatgcataggcaaaggctgtaatggctattatcggagctagaggatcagtcttccgtatttctaaagtcgcatcatatccattcatgacaggcatgtttaaatccataagtacgatgtcaggagattcgtttttaaacatatccaccgcctcttttccgttccatgcatgtaaaaggtagtaatcatccttaagtatagtctggaacaatttatagttactgtcgttatcctctgctataaggattgtaagatgttttgttttagatttgatctgtttttgcttttcttctatttttatcatttcttgagccggtacgtaaggcagctcaaaccagaagatcgagcctctgccttcctcgctttcaacacctatttgcccgttcatattctcaacgagcatgcggcaaatggaaagtcccaatcctgttccctgggcgaaatggttcaacttgacaaatcgttcgaagatgtcattctttttttctgccggaatacctattcctgtgtctttgataaagaaatacaaccttttacctctgatttcataaccgaaacggatagaaccttcggtggtaaacttgattgcattgtttaccatattaatgactaactgggatattctgtttttttctgcgtggatatggcattgaggacttcctgctttgaatatcaactgcactttttcgctttgtagtttcagtcttaagctgttctctaattcctgcatcaactggtttagttcgaaatcgctgtaattgaattccatggtacctgcttctatcttcgataaatcaagtatatctccgatgagttgcagcaatagtgtattattattctcgataatacttatgtattcttcctgctcggaaggctcttgtatcgaaggtagtaatgtggagaaacctacgattgcatttaatggagtacggatttcatggctcatattagctaagaaagcagatttcaacctgttggattcttcggccttatttttagcatcgagcaggctgttttccatttttttacgttgggtgattaccagagatgatccgactaatgtaatagggactccattttcatcacgggtatctactgcagcctgggcctcgatccaatctacttgaatgccctggtcggtatggctgactacgcggtattcctcttttactttcaagcatttgccttctatcagttcggtataagcttgttgtactcgctggcgatcttccttatatatctttccgaaatattgcgattcggggacagacaatagcttttcactcaggctatcatccgtaacgtcgagttcgacctggcggtttacgtcacacaaaatggtgtgttcacgcagatcccacttccagggaacgatattggcgatgtcgagtgccatcgcaagtttatggttaatcgaatccagtttcacttgggtgtgatgaagatctgtacaatcgacaccaaagatatccacgaagtcagactggagtgagaaagtcagcatgatgttgaaataggcagaagactgtttcaggtaataagtgaaactgattgtttttttctccatttccatgaactggaaataacggatgaacatcgtcaatgcatcatccgggagatcactcatttttttgccgacaatatctctgtccaggtgcatcgcattcaaataccggttgtttaccttatgaatgattgcatcgatcacttcgccagcctgattacgtatcagttgaaccttgcaatatagtaccggcatattctcgaaaagattgcttaattccgcatttgcttcaatctctttttgctgtgctatccgcaacgctttaagtgattttatgcgattgaattgatacaatgtaaaaaatattaatatgatgaataagacaccgagtgctatcaggtggtatttgtacttttccaaagccgttttaggaaggtttagaaaaacagtacctgcggggcataaattcgtattgattcctttttgcagaagtgtcggataatcaaatacaggttgtccttctggaatgtaaaaaggaatatccctgggggctttgcctgcgagaacggcgtccaatgtcgtttttaactgtttatcgaatgtttgctgttgatagaaataaccgccgagcatcctgctgtttagcatgactgcatcccctaaggcgaagatcggaatggttgcattggaaataacctggaatgtattagccattaacagatctcctccggcaaaggtttggcgagtgaaccaggatgaaaaaagtaccccggttgtgtttctgtctgttgtatttaatttaaataataaagagtctgttgtcatttccgccgcagagagaaaatcgtattttaaatccggatatgacttttttagtaaaatgcgtaaatcgtggtctaattgctgattgatgtaacggccgtctccgataaatgttaatgtttccatgccggggattatattttgcatcagttcgatgttttcaggcaggtaatttttagtttgcaacaaggtgaggttatagctttccgtcaattgctccaatggaacttgctcggtaatttctgccggatatttttttatatagtttgtagtaggacttaagtagggtaactcggcacataagatcaaaggtatgtcatcaccccaatgctttttgaaatcgtcacacatcatgaaggaactgtttcctaataacaggatggctttaggtgcatgtgtgtatctgggaaaaaaagactctttaaacttgttcagtttggcggaatcatcgatcattaacatattcatgttctcaacgtagaaatcaagatgcgaatttgccgctatttcctgctgtatagggctaatgagagcattactccaggttgcatcggaggtataactgtttagaaccaataaataatctttattggaaacagccgaattgttagctactgaattcatgacacaggcaagttgcaggcctgtaagaattattaaaataatgttgaggtgtatattatatttcataataatacaatatgaaattttaaaaattgagcaaatatagtgttttttctgatttctatgatatccgctgatttttattgcttcttttaatgaaaaaacatatatgtgtctgtgtgctgttaaaatttgttgatataattttttgttaatcgttgttgtggcgtatagtcgttcaaacatactgttaaaagtaggcattaaggatcgcggtacctacttttggcacattgtaaaatctttaaaaggcttcggcgaagttgaacacaaatccacctgtatctttcccaaaaccatagtcaacacgcgcgtttacgttatgcttaaactctattcgtaattttatgtcggataaactcgcatagtttagattaaaggcgcccccgatatggaaatgcttgcttattttataaacataatctgatttgtttcctgtttttctttcaaaggtacggtctatattaccatatataaagctgttccagtattttttcaggacgccgtcttttttctctatacgaatgctatcttgttgtgaataaagattcgtggcaataggaacggagaaaataaaaagaaataaaaacttaagtttcatcttttgtatgtttggacgttagggttttatttccggaaacaataggccaaacccagactgaatgtttgtgggtgcaatgccgcagaactaaattatgttttagaacagttttttgttaaacgttattaaatgaataagaaacacaattaataagttgtgttatataacataaatgcactatgtttgcactgtgtttttcatggtattagatttaaggttaacaatgaagattggctgtccgtgacggatggccttttttgttttataaaggtttcaatctttgtatccgtggaaaaaggcttatctttgtacttcataaatgtaaatgctccgataaataatatgaaaagaatattctgtcccaaatgtgataatcagctatcgttcgatgaaaccaagtatcccgatggacaagtactggcttttgtgtgtcctcaatgcggatcgcaatttaagataaagctgggaagaaagacaatccgtaccgaatccggccaggagaaagaggtgaaagaaccggatttctcttgcggctatatcactgtaattgaaaatacgtttggttttaagcaagatctgccgttggttttgggagataatatgattggacgtagaaataaagacacggaaggtgtggatgtccctattattaccagcgatccgagtgtgggacgcaagcattgtattattaatgtaaaacaggacaaggaaggtaagtttatctataccctccgtgataaccagagtatgactggcacgttcctccgcagtgttattttaggaaaaaaggaacaggtacggattggtgaaggtgcgattgtaaccatgggtgccactacatttatacttcatacggctaacggggaggaagaagaagagttttaagtaaactttagacgctgtaccgaagtgaaaatagtctcttacatcagggcgataagggagatagggggaattggcgtaggtttcgggagagatggatacaagatttcctttcatctccggcacagttctaaagtttaattctcattatttatgctctttgtttagttgttcaacgataaaacaactgtaaggccgtttggctcacggcagtttacgtaaagaatcaaaaagatctgaaagaaaagttttgttaaaatggcgcattattgcggtactgacattaaagaataagggttggagaggtgtttgtggaaacaaatctgaatgttaattgatagaattttacatcttgaaaaaacactgtcttttcaattttcccaataaatccgttcagtaaataaatatccggttgttagtgagccttcgtttttattatgtatttttgcggctcaataggcaaataggttacaaatgggacaaaatagggtagagtcggcaagtgggattaccttccggattttagtggcgttaagtatatcgcattgtataaatgattcgttacaatctgtcattacagctgtttatccgttatttaaagatgatctggcactgaattttgctcagatcggtttgattacgctggtttatcaatctgcagcatccgtatttcagccgcttaccggattatacttcgataaaaatccttctccgtggtctttacctatcggtatgagttttacattgatcggtttgctcagccttgcttttgcaaattctttgccctgggtattatgttccgtcgctttgataggcgtcggttcgtcgatattccatccggaagcttcgcggttgacttcattggcctcaggggggaagaggggactggcacaatcgttattccaggtgggcggaaacctgggaggctcgttggggccgttattggttgctatcctggtagctccttacgggcgcagccatattgccttattttctattctggcctttatcgctatcctgatcatgacttatgtgggacgctggtataaaggactgcttcagcggtttaagcgtgaagacacaggctcttcgaaacaccatatcgaaatgcctttgccgctgggtaaaacgatattttctatctctatcctcctggttcttatcttttccaaatacatttatatggcgagcctgaacagttattacaccttctatctgatcgagaagttcggtgtgagtgtgcaatcttcgcagttgttcctgtttgtctttctgatagctactgccctgggtacactgttgggaggtccgataggggataaggtgggacgcaaatatgttatttgggcatccattctcggtgcggctcctttttcgttggtaatgccgcatgtgcatagtttatatctgacggccgtcctgagtttttgtgtcggcttgacgttatcttctgcatttccggctattctggtatatgcccaagaattgttaccttataagttaggacttatttctggtttattctttggttttgcttttggtgtagcagggattgcatcggcagtgttaggtaatctggccgaccactatggcatcgagaccgtttacaatgtttgtgcttatatgccgctgatcgggctggtcacttggtttttaccggacttgaagaaagcctctaaaaaagggagttagctcgctgaacaatcccggagagggctttgttattaatcaaaaattcgctcaaactaaatttaaacgcatttatgattaataacttaacgcatttcagtattggcttgctgtttctttttcctgtcctgacttctgcccagacggagacggtcgatctgaccttggaacagtcgatggagctgcttcagaaggagaaccgaagtatccggattgcgggaaaagaggtggagctggcaaaaaacgaacatcagaaattgaactctttttggtatccttcggtcagtgcagccggtgcctttgtacatatgtcgaatccggtcgaagtaaagcaaccattagaccagttcactgatccggcaaaagattttgttcattccatcatccccgacgaccagtttatctcttctattctggataagatcggacagaacacattgactcttccacttatttcacagaatatcacttccatcgatgcaaatgtcacctggcctctttttacaggtgggaaacgtattttcgccagtaagatcgggaagacgatggtcaatatcgccgaagtcaaccgggaacaggttaatgccaaccaacaatcgttattgattgaaagctatttcggattacgtctcgggcagcaggtggtcgccgtaaaggaagaaacttacaactcactgaaaacgcattatgaccaggctcttaaactggaacagaacggcatgataaaccgggccgaacgccttttcgcccaagttagcatggatgaggcaaaacgggaattggaatcgtcccgcaaagatttggaagtagcccggcaggcattgaaaagtcttctgaatatggaagaagagaaagatatcagtacaacgacttccctctttatcaatacgaatattccttccgccgattattttaaagaattggttcctgccaataactatctggtcaaccaattaaaactacaagagaatattgccgggagtgaattgaagatcggtcgctccggttatgttccaacaatcgctttgttcggtaaacagactctttattcgcatggagtggataaatacctgatgccccgtacgatggtggggatcggctttacctggaatatcttcgacggattgaaccgggaaaagaagatacggcaggctcgcctcaccagtcagacgctggctatcggaaaagataaagcggtgacggacctgaaggtaggagtcgataagtattacacccaattacaaaacgcactcgataatgtaaaagccctgaatactacgctcgaaatgagtaacgagctggtgcgtatccggcagaaatccttccaggaaggaatggcaacatccaccgaggtggtagatgcggaagtaatgctttcaaaagtgaagactgcctttctgctggcctattaccaatatgatgtagcattaatcaatctcctgtctatttgcggtattccggaatcattccatcaataccggttagagggaacgacggagataatgtaggaaatattgaatcaacaataaacaaaaaaaattatggacaagactaagaaatacctgacgatctcctttatagtggtactgatcgccgtaataattatatctgctgtcggcatactgctactgaagaaaaagccggttatcctgcaagggcagattgaagcaaccgaaatacgcatatccggtaagttacccggtagaatagatactttccttgtcaaagaaggacaaaatgtaaaggccggtgatacgctggtggtgatcaacagtcccgaagcaatggcgaagtaccagcaagtaaatgctttggagagtattgccaaattccagaatcaaaaggttgatgagggaacccggaaacagatcatagcatccgtagaacagttatggaacaaatcgaagtccgacctccaactggctaaaacaacttacgaccgtatcacggccctttataaagacagcgtagtcacttcccaacgaaaagacgaagtggaagcactctataacgccgctgttgctaacgaacgtgcctgctataatgaatatcagatggccctcgacggtgcccggatacaagataaagaaagtgcccgttcactggtgacggcagcacagggaacagtcaacgaagtcgaagctctcctgcaggatgcccgcctggtcgctcccgaatccggtcagatttcgaccattttcccgaaacggggtgaattggtaggggccggcatgccgatcatgaacctggtggtacttgacgatgtgcatgtagtcctgaatgtgcgtgaagaccgtctgccgttatttaaaatgggaggtacatttaaagcggacgttcccgcaatcgcaacgaaagatattgaattcaagattaactacgtcagtccgctgggtagcttcgccacctggaaatcgacgaaacagaccggaagttacgatctgagaactttcgagatccatgccctgcctgtaaaaccggtcgacggattacgcccgggcatgtctgtcctgcttaatttgggagaacaataaccggtatcatttatgagtagtaataaacaacatagtcctttttacaatgtatttcatcgggaactacatcggatggtttcacgcaggctctatttcggggtctgcatcgtgttgcccctgttctgtatcttcttcatgtctacgatcttcggtaacggacagatggaaaatattccggtgggcattgtagatcaggatcagaccgctttgtcgcgcgaagtaatccgtcaggtcgaagccgttcccactttccgggtgacacggcattacgtcgatgccgagacggcccgtaaggcgacacaggcaaaagagatatatggttacctggtgatcccgaatcaatttgaagcagacgtgacgggtgggagacaggctaccttatcctactattatcattacgccttattgagtgtcggtggtgaggtcagaggtgctttcgagaatgtgctccgtacactatccatgtcaccgatcgtttccgaggctgttgctatgggcatcaaccagaagcaggtaacgacttttctacttccggttgaggcacagaaccatccgctgtacaatcccgatctcgattactccgtttacctgagcaatccgtttttctttatcttcttccaggtgatcatcctgttgactacggtgtatgccgtcggtagcgaactgaagttccgtaccggcgacgagtggctggcaacggctgatatgaatatggttaccgcccttttcgggaaactgttgccttacacgattatcttttccctgatgagtatcttcggaaattatgtgatgttcggtcctatgaatatcccattctcctgtgggttctggccattgaacctgacttcgatcctgtttgtgatcgcaacgcaggcgctggccgtctttctgttctccctttttccggcgatcagtatcattatcagtatcgtgtcgatggtcggatcgttgggagcgaccttgtcgggtgtaacttttccggctccatccatgtatgctccggtctattacacttcgttcctgtttccggtacgtcattttgtcgagatcaatcaaaatcttttgtacggcgactatgggtttgcctatacctggtggaatttcagtgcgctgttctgtttcatcggggtggcttttctgatggtgccgcatttaaaaagagcaattttaagtcataagtatgaaaacatcaaataatataaaggcaggtttgactaatatatcctctatcatcctgaatgagttcaagaccatttcgggcagcttcgccatcgttctggtattgatgggaggtattttcatgtacggtctgttatataattatatgtatgctcccgacgtggtacgaaatgtgccggtcgttgtggtggataattcgaagacagagttgagccgcgaatatatccgcctgttgaatgcaacgccacaagtcgatgtgatagctaccggcgaagattttccgcaggcaaaagagttgatgaaacgtgacgaggctgccggtatcttatacctgccgtacgattttaccgaccgggtttcgcgtggtgacgagtctatctttatcatgtatgaaacgaccaatgctttcctttattatatgtcgatacaggaagcatcggccggctctatgctggcactcaacgaccgttaccgcccggagatgctggtcttccttcctgccggggatgcggcgcaactggcttccgtacagccgatcaatgttgcgggtacggctttatataactacacggaagggtacggtacttacctgataccggctgtattgatcgtcattatgttccagacgttgttgatggtgatcggtatggtcagcggggaggaacggcagtttcatttattacagtcctatccttcttcgcttgcacaggccatgcggttggtcaccgggaaaacatttgtctatatgatattgtatgccatcttctccttcttcctgttgggtttgatcccttttatctttgacctgccggatatcgggaatgtgtggaatatcattatgttattgatcccgtttctgatggcgaccagtttcttcggcttgacggcatctttgttctttaccgactccgatgcccctttattgatgatcgcctttttctctgtcggtctgattttcctttccggcgtatcttatccattggaattgatgccctggtattggaagttatcgcatttccttataccggcagcaccggccactttggcttatgtcaaattaaactcgatgggagccacgatggcagagatacatacggagtatgtgacgctgtgggttcagtgtgcggtatattttatactggcatgttgggtatacaggtataatatcagtaagtcgcatcggtgacgtttcacctttcacattgctggtaatgttttggtattgagtgaaatacagtgaagggcctgaaacctcctaaaaaagtcaggacttttgaaaacgaaagtcctctcttttatctttaaaagtcctgtctttacatttcaaaacacccttgttttttccaggcaagatatttataaatgggtaactatctatttgggaatgggtagttgcccatttattgtttggtgccgtcctatttgtgaaaggatggtgaagggttacctttcactatatgtcgttatttactaatgagttggggcggttgtgacaggtgaagcctaaccagctgcatctgcctgctacgtacgttagcggataaatttatactcagacaatatgtacaaagataataaagtattacatttgtcggcatatctgataacatgagaaaagaaatgaaacaaacactattactacttattttaatttgttgccatttattaccggcaactgcgcagaagaacacccctaaatggatggataaaagtaaaaaggccgttgttttaatcactacatacgggaaagacggagctaaactgacctcgggaactggtttctatgtttccgaaacgggcgatgtccttgctgcttacgatctatttaaaggagctgagaaggcaacgatcaccgatgtggatggaaaaacctaccccgtgacggctattgtcggagccgacgaattgtatgatgtcataaaagtgaagagcgaagcaccgaagaaagtgcagttccttcccatcgcttccgatccgttggccgtaggaacagcagcttatctgttaccgtatactacggtaaaaacgctcaacttcggacagggaacgatcacggaagtcagcaagctgaaagatccttacagctattataaattatcgatacccctggaagacggacaggtaaatgctccgatcctgaatgccgaaggtcaggtattcggattggcacaggcggatgcttccggtaagaaagatgtttcgtatgccgtatcggctgcttataccaatagcctgtctgtggctgcaaccgatttcctgaatacagtctataataatataggtataaagaaggcatggccggcggatgaagaacaggcgcaggtcgctttattcctgaaaggtagcacacaagatgcgaaaagttatctggaaacattgaacgattttatcgctactttcccgaactcggcagacggttatctgaaccgtgcctctcactatgccggtcgtcgtgccgagctggcttctaccccggctgaacaggctaactatctgaataaggcgttggatgatattaagactgcttcaaagtttagcgataagaaaggggacgtttattataatcaggccaaactgatctataatgtagccgccggcgatacgaccctgaccgatccggcatggtctgtacaagccgccctggaaaccattcagaaggcaatccaggaggaagatcttcctgtttatcaccaactggcgggagatatccatttcttcctgaaagaatacgaacaggcttataatgagtatatggttgtgaataacagcgacctggcatcgccaacttctttctactgggctgcaaaggcaaaagagaatgtaacgggtttcaatatcggtgatatcattgcgctgttggatggtgcgatcgagaagagcggcttgccgttgactccggaagccgggcaatatatccttgaacgtatcgactggaagctacgcctgtcccaatatgcagaagctattgccgactacgacctgtattacaaggccatgaacggtgatgtaaccagcaatttctattattatcgcgaacaggctaaattccgttccgatgatctggaaggtgctttagccgatatcaaagaagcgatccggctgagtccggatattcccgactaccgtgcagaagaagcttccgtttatgtccgcatgaaaaactataacgatgcattgacgagtatcgacaatgccttgaaagtggctcccgactttgctgcttgctatcgtctgaaaggtatctgctatgtccgtatggagaagaaagcagaggcttgcgaagccctgaacaaagcaaaagagttgggtgatccgttggctgaaagactgattaaagaacattgtaaataaaatatcggatatgaataacgtgaaaagtattttcatactggcagcgatgggggtatgcctgatcggaacaaacagctgtaaaggcaagtcggagcaaagtggagagccggcggcagagaagacggaaacccgtgccaaagtagaggctaccctttttgataaatcgcttcccgagatcaaagaactggtcgatggaaaatgggaattagtcagtggccagaatgccgggcagctttgcgagtttgaaaatactttcatcacattcaacggcgataaatacatctggtcggaagatggcaaagacgagcccggcgacctgaactggcgcaaagccgataccggtgccggctacgaagcctatctgatggatgccttctatgccaccaatccttcctacccgttggcgataagcggtgataccttgtttattcaggattgtacggagacggcgtataaatatatgttggtacgacgataggtctcagcgaagccggtgcagccttgaacttttggttacttttcttgcaagagaaaagtaactttaatcccataaactgagttgtattcctccctttcccttatcctctttctttacaggctttttagcatcaccaaaaactgtctttccaccatatttataagacgtatcccgttcatgctgtacccaatcatcaaaatatttgcttggcgtatatcctttttctatttcctgtgatatcttggacaggttcttcaaagcatccgatttatctttatccccgagacgagcctgccgtatggctttgtcgaatacttcaaccgtctcatcataaacacttgtcgggacaggaaacggatgtccgtctttccccccgtgtgcgaacgaaaaacgggctggatcggagaagcgggatggagtgccgtgtatcacttcgctgaccaatgtcagcgattgcagcgtacgtggcccgacaccttccaataaaagctatgattccatatcggacacatttgtctcatgggctaacaatagtgcagcccccagacgtttcaggttaacatcttcctctcttacttcatggtgattgggaagaatgatagaaacttcatgcatcaacttttccggtgtctcttttgtcagttcgacgattccctctttggtaggggcagccagtttatctgtcaggttaagtatcaatccttggtttctgccgcaaacggaagtatgaggttcttccataaacgaacggagcgaagacgacagccagtgataacgccgggccatacgctcattcgggttcattccttgttgtatgacagaccagtcgccctcttgggtgacgacaaacgtatgtagataaagttgaaaaccatcctgaacggctgtattatcaactttggccgccagtttgctgcatcttaccagttcatttccattcaatccggttttatcggctacttccaggagttgattaggtgtttctcttgaaaacttaccccttcctccgcaaatataaacacccagttcttccgaccggtaattgatcgcttttctcagggcattcataacagatgtcgtgatacctgacgaatgccagtccattcccaacacacatcctaacgactgaaaccagaaaggatcactaagccgtcgtaataacgccggacgaccatattcgataataatagcttcggcaatggctcctccaagcaaactcatacgttgagccagccagggcgggactgttccgtaatgtaatggtaaatcagctgtacctcgtttcatatatgcgaagatagataaaaaacaaaatgaattcagttaatgaagtgctaataaagcaacaaatgaaatggaagcagtgttattatttagaaatcaaatagtaacagatatgtatttggaagtaaataagaacgatcatgttcaaggtccggtcaatgcaccgatagaattaattgagtatgcagattttcaatgtccctactgcgggagggcttaccatatagtaaaagagatacagaaaaaactcggaaacaagattaagtttgttttccggaattttccactgacagagttgcatccgcatgctttgcatgctgctattgcaacggaaatagccggttcttacgggaagttctgggagatgcatgatcttctttttgagaatcagaatgctttggatgattattatttattggaatatgccaaaaagttgggaataaaagctgccgagtttgagacggatttcagtaaagatcgtttctatcaaaaggtgaaagacgattacgactccggtatagagaataatgttcagggtacaccgacatttttcgttaatggagagctctatgacggcaactggatgacttccgaatttgcggagtatctggagtctttaatatcttaatagtcatgaagaaattaagtttggtaatattgacctctttcttgttggttgcctgtggtgcctataaatatctcgacttggggatgttgacgaccgggatgaccattgccgaagtggagaaccttatggggcctcccgaacgggtattggctgtcaataagaaagatggctatgtacaggaagtgttggaataccggacgggcaagaatgaagtgtatgccctggaattctgggataattacctgacaggctatgagtttttatatgatgatgtaaattatttgccaccgatagcccctccgatggtgtttcccccttatggccgtccgatttatatccacccggaccatcgtccgaaccacccgaatcgtccgaacaggcctagccgtcctgaatcgaaccgtcccagccgtcctgaaaccagtcgccccgaatcgagccgtcctgagacaaatcgtcctacccgtcccgaaacgaaacctgaggtaattcgtccaaattcgggagcaagtaatcgtacggaacattacaataattcgacaaacagtcagacaaataagaatgaccgttctaattcatccggtagaaacggtggacgaagatagtcgaaataaacattctttatacaaaataaaaagctcctgcagtcgatgaatgcaggagcttacctatatatgaagtttttaattacttcttcatagcttcctcgatagcaacagctacagcaacagtagcacctaccatcggattgttacccatacccaggaatcccatcatttctacgtgagcaggaacggatgaagaaccggcgaactgagcgtcaccgtgcatacggcccattgtatctgtcatgccataagaagcaggacctgcagccatattatccgggtgcagagtacggcctgtaccaccacctgaagcaacagagaagtagttatgaccattttccatacattctttcttgtatgtaccggctaccggatgctggaaacgagtcgggttagttgagttacctgtgatagatacgtcaacaccttcagcacgcattacagcaacaccttcgcgaacgtcgtcgcaaccgtagcattttacttttgcacgaagacctgttgaatacggatattctttgatcacgttcaaagcgcctgttgcatagtcgaactgagtctgaacataagtaaagccgttgatacgggaaatgatcatagcagcatctttacccagaccgttcaggataacgcgcagaggttctttacgaactttgtttgccatttcagcgatcttgatagcaccttcagcagcagcgaaagattcgtgaccagccaggaatgcgaaacattttgtttcttcgcgaagcagacgtgcgcccaggttaccgtggccgataccaaccttacggtcgtcagcaacagaaccagcgatacagaatgcctgcagaccgataccgatagcttcggcagcgtcagcagcgtttgtgcaacctttcttgatagcgatagcagcacctacaacgtaagcccagcatgcattttcgaaacagataggttgagtttccttacacattgtataaggatcgatacctttagcgtcgcagatagcttttgcatcttcgataccgttgataccatattcttttaaaaccgcgttgatatgatcgatacgacggtcgtaactttcaaataaagccatattatttttacttttttaaattcttatttaccaggaataaagatattagaaagttgaaaacaagtacaccgccgcaacaggccatataaaaagccatccagggacggtccggcttcatgacgaagtaggtgattaccgtcgcgataacagttatgataattaacccgattaggacgcgtgtcagtgttttcttattcattacgaggatcgatatattttacagcttctttgaaacgaccgtaagaacccttagctttttctaatgcttcgttagcatcgatacctttctttaccatttccatgaatttacccaggtggatgaattcatatccgattacctgatcgtcagcatctaatgccatacgggtacagtaaccttctgccatttccaggtaacgagtaccttttgccaaagtaccgaacatagtaccaacctggctacgcagacctttacctaagtcttccagaccggctccgataggcagaccaccttcagagaaagctgactgtgtacgtccgtaaacgatctgcaggaataattcgcgcatagctgtgttgatagcgtcgcaaacaaggtcagtgttcaatgcttccagaagcgttttgcccggaaggatttctgatgccatcgcagcagagtgagtcataccagagcaaccgattgtttcaaccagagcttcctgaatgattccttcctttacgttcagtgtcagtttacatgcaccttgctgaggagcacaccaacccacaccatgagtcaaacctgagatgtcagtgatctgagtagatctaacccattttccttcttcaggaatcggagcacaaggatggttggctcccttctttacaacacacatgtgttgaacttcatgtgaataaatcataatcgctaatttattatattaaagtgataataaaactttttgctaatttctatgtaatatcgctttctaaaagaccgcacaaagataaaatttttaatccagccatgcaagacggaaagttcgttatttctcggttggctgaatattaagttcggtaccgttaagcagtattcggtaagtgatggggcctatctttttcatcataagcgctacaccgcagtatttttcctgtgagaggcggatcgctttttctattcgggcgctgtcgtcggcgcttcctgtaacatggtatgttacgtcgaatgctgtatatagcattgggatggtatcggatgtctctgctttgacgtcgatcgacaacttttcgaagcggactctcatttttttgaaaagagagaccacatctaatccgctgcagccagccatagcaaccagcatcaaagcttttgggcggacacctgaaccggtgccgccgtcttctttgctggtatcgattgttaccgtatggccatccatctgtgtctcaaagactgaatcttttttccagtcgagggttatctgggcagacatgtcgtaactttttatttaataacttcctgcagtttaatatctatttcctctccgtggatgttcttggcgatgattgtaccgtctttgtcgaccagaaccgtatgaggaatgctgtttactccgtatagagcggcacctgcattctgccagcctttcaggtcagatagttgtatccaggtaatgttcaggtcttttacaccttttgcccatgcatctgctttgctatccaatgaaataccaacgatttcaaaacctttattcttgtattgtttgtatagttcgactaaatgcggtgtttctttacgacaaggaggacaccaggatgcccagaagtcgatcaggacaactttgccattacctacaaattcagacagtttgtgaacttctcctttaggatcagccatttcgaagtctacgaactgtttgccgacagcgacatttttcagtatttcgaggcggctcatcattttgtcgatacccgggaatgccttgaaagttgagtcagcctgtgcgatgatttcactctgttgttcctcactcagactgtaacggttgtcaaacgtatatttggcagacattttttgatccatatgggccaggatataattacagattgcccgtgtgattttttcgctgaattcgtcatacttcttttcagcggcattggcaatatctttatcttcagaacggatggcatcccccagttttcccatttcatcataaattggagcgatctcatctttcaaagccttttctgcatcattggccggtgttccggtcacaacagagaatgtgtcgaggttggcgatgatttttccgttttcaagagtgaatgttgttttaaacaaattgggtttgccacgttcttcgggaacaacatccgtcgagaactgaagagtagcaagcagcgaaccctcttgtgtccctttgaatctgaaagtgttattttccactaatgcactgtccagaggtaagacatccggatttccgtattcatagaggtatacatactttccattcagatcggcgtttgatactgtaccggttatttcgtaacccggtttttcgctgcaggctgcaagaagcagtgcggaagcaacaagaggtagatactttttcatatattatatgtgttaaaacgatattatcaccttcgaatatgcgaagttatcgctttattaataatcctttatccctttaagcttaaaaagttttaatattacggaaaagatggattatatttgtcgtctgatcaataataaacataataatgactcgattcctatcaatacgatttctattattgggcttattcctgctgtgccccttttttaaaggagcggcatcgatagctttccataaagcgaataatattgatttgtcgaataatgcgataatagatatttaccaggatgcccatggttatatatggcttggaacgtatgacgggttgaacttgtataatgggaagaatacctatgtttaccgtttcgaacctgataataaaaatacactttgcagcaatattattcataagatttcgggaggtggaggagaatatttgtggatttcgacctcgatgggactgaaccggttttcgttaagggatcgcaaagtgacggagtcgtatatggaatatcccgaatgccgcctgattgttgcagactctctggaaaatacgctattggtaagccggaataattttatttcctgttataccgtccgggctggttcttttcaggatatttatacggaagggataactccggatgcagtaaaagccttgtttaccgatgagcaaggggatttttatatcctttcgtctgacggctttctgaagaagatcgttccggattattctactttacctcttaaattacagataaaggaaagtaaaatacatgataaagagataaggcaggctttttatgaagaaggtattctctattatgtggatacagagaacaaattgtatcaatatggaatgaaggataaaaaggaaaaatatttgtctgatctttccgtatggatgaagaaatatggggatatatcccgtattgtctcttttcagtcgaaacaatatctggcgttcagggatggtttattgatggatctggatgatccggaaggagctttcgatctgaatatcggtatttttagtatgattaaagacaataagcagaatattctttggatcggaacggacggacagggtgtcagaatgttttacgataagtctgagcgttttgacgggttgttgctggaagatttgccttttgtgatgcgtaatcctgtacgttcggtttataccgacgaagataaaacgttatggttcggaacaaaaggagatggatttgtccgtataaaggagtatgattcttataaaggaaaacagataccttccgataagataacccgttataccacagccaacggactttctaataaccgtgtatattgtttttataagagccggtatcattctttggtatggatcggaacggatggtccggggctttcctattattcgtatgaagatgggaaggtgtatacacttcccagtaagatcgatacaaaattaagatttgtgcattccatctgtgaggtgaacgattctattttatgggtagccacgacaggggatggattgatcgaggttattctggagaaaagtaaatcggggctgggcgttaaatacattgattcctatcagctggagaaagatgggaaagtctgtaacgaattctattcgatgtattatgacggaaaatcgactatatatctgggtagccgcggcggatacgggatggcacgttttgacctgttaaccagggaatatgactttatgtcgatgaataattcatccaaccaggcaattggtgacgtgttaagcctgtattatagtagtgactcgaccttttatctgggtgccagttccggaatgacccgtatgaaatgtaattcatcaggcacctgtgatgtcagacagttcgacaggagtgacggtatcagcaacgatatgatccacggtatactggaagaccgggacgaatgtatctggttaagtaccaataaaggattgacgaaatataatccccgtaacagtttcttccacaactacgggcatcaggaattgaaagtcacagaattttcggatgacgcctattggatatgcgaatataccggacggttgtttttcggaggtatcgacggtctcgtctggatcgaaccccaaaatgaccagttggaaaactttcggccggaccttcatttctttgaactgaagatgggaggggagacggtaagtctttacgaccatacggatgcagagtctgcccagctcgtgattcctccggatatctcgacgtttaatatctcgtttgttgcaacagattatattcatggagaaaactatgaatactcttacctgttgcagaattataataccaactggacggaattacagaagaataacgaaatatcgttcaccaaacttccttacggtaactatgtactgaaagtccgctataaaaacgatgtgtacgactcgaatgcccgcgaataccttttaccgttgaaggtacttcctccctggtatcgttcaacctgggcaatcgtattatatgtgtttgcttttcttcttttattaacgggattactctaccgtttcaaccggaggatggcagaaaagcaacaactcgttgcacggaagatcagggaagaacaaaaagaaaaactatatgaggcaaagctgaatttcttcgccaatatcacacatgaactttgtactccgcttactttgataaacggggtgggggattatatccatacttatgcagagaatacttcggataataaactgataagatatatccgtatattgcgggataacgtaataagtctcaacgaactgatccaggaaatcctcgacttccgcaagatagaggaagcgggaatgaattatttcagtattaaaaagacttccgtttccggtattatccgcaggcaatacgactcttttacccctattgctgagcagaacggaataaactttacgatgtctctgccggactctcttaattggaataccgatcctaccggtctgaagaagattttggttaatctgatatccaacgcttttaaatatacggacgaggccggcagcatccgtatctcggcaatgatagaggatgattcgttagttatcagtgtatataatactggtaaaggaatatcggaagcagacctgaatacaatctttgaccgatatcgtatactgggtgatctggatggaaacaattacacccaaatgacttccagaaacggtttgggattgtttatctgtcatagcatggtgcagtctttgcgtggtacgatagaagtgaaaagtgaagaaggtaaatttgctgaatttatcgtccggttaccatatctggaagtggatgaagacgatatggtggaagaaaacgaagaacctgatgcctgtattttgccgacttctccggatcagggggagatggggataccggtttctgcggatgacaaaccttgcatccttgtggtagatgacaataaagatattgtctggcttatcaaagaatccttatccccggcttatacgatagaagaagcgttcagtgtggaagatgcacttgctttgatggagaaacaaacaccggctcttattattacagatataatgatgccggatatagacggcctggagctgatcagtcgcgtgaagtcggataagtttacccggcatattccgttgatcatcgtttccgcccgtatctccgaaaacgatcaggctgaaggattggacttgggggctgatgcttacctgactaaaccgttctcgtcggttgtcctccgttcggtggtgaatcgtctgatgacaagtaagaaggagttgaaagattactactattcaccggaaagtgcttacgaacaatccgggggacagttgatccatcaggaagacaaggaatttatggatgaggttattgctatcattacagagaatctggataaggaaactttgcgtcctgaactgattgcagagaaaatgggtatgaatacccgttcgctctaccgtcggttcaagaaaatatctccgcttactccgaccgactttataaaggattaccggctgacgtatgccgcccaattattggtaacgaccaatctgaatgtacaggagatcatctataaagtaggtatttcaaacaaatcctatttctaccgtgagttcgcttccaagtacaatcagacacccaaagaataccggaatacccggtaaatgcctgattttctgttggtgtcataaattaccaaaagagtgtcataatctacatcaggtatattatgacactcttttggtatttgaggtataaccctgggaaatggaaactgactaatattgcattcgagaattatcaccgcccttgtttgataggcattttctgacaaaggcgtttttggggagttgttttctttggatagtgaatgcattattgagttaacagtaaagttgtgttgttatgaataaatatgtaattgtagtagttagcttactcttattctctgcatgtagggaaaatatctctgtaaatgtcccggaattatcggacggagatcctaccacttgttatacgggagcgcagggcttaaataaaatcgtttttgatactcaatgctgcattcctatccaaagttacaaactctactcatcaggagaaacgccggaacacgatccggcaacctggacattaaaaggttcgtacgacggaacgaaatgggtggtgattgacgaacgcaaagaccagcgtttctgctcccgctatcaggagatactttgcacgatagctaatccttcaaattataaacagtatatgctggaagcagccactgagggaaatgatatattgataataggcgatgtctctttctctgaaaagaatctcctgacggactggaaagatttcagatatcccgaagtagacttcgaggtgctcgatcctcagacaaagggggcgtctatctatgccgacctggtgcaggatccggatgcttacataaaatatcatgccgaaaaagtggcggaaatccttttctataccgctcaggatacgatgaatgacgtgcagaccattcaatatacactgaaagattacgacggtgtatctgccaaatccggcaatccacctgttatttccatcgaatacagtacacaacacatagagaagtcggcaggcgagtcgttgtataaactcgacttcgagacacgtggcgtcttataccatgagctggtccatgcctatcagttcgaaccgagaggtatcgggagttattctaccaataaggagttctgggcctgtattgaaggaatggctgatgctgtgcgggcagaagccggcttttttgatatgaatacacgtaagcccggaggtaactggatggatggttaccgcacaacgggtttctttatccaatggttgaaaaccaaagatccggatgctatacgtaaattccatctgactgtccgtgacttggaagtctggagtttcgataaagcgataaaaagtgtctttggtgaagatagcagcatcgaaggtatgtggaatgagtaccaggcgttcctgacgaaataacaaatacattatatattatgaagtcttcaacatgtttagccttaattctgtctgctttattggcaggaggaaatttatttgctcagcaggataaagtctcattagtgaacccgatcatcgggacaaacgggatgggacatacttttccgggagcatgcgtaccgttcggattggtacagttgagtccggataccgatacgatcccgcataatgtggacggcaaatatcaaccccgcgcttacgaatattgtgccggttaccagcataaggacagcagcatcgtcggtttcagccatacccatttcagcggaaccggacattccgacctgggtgatatcctgattatgccgactaccggctgcctgaaactgaatcccggaacagcaaccaatcccgacggcggctatcgttcccgattctcacacgacacagagatctcccgtcccggttattatgaagtgatgttggccgattacggtgtaaaagcacaactgactacaaccaaacgggcaggaatacataaatatactttcccgaaagaatcgaagaatcagcgtattatcctggatatgatacatggtatttataactacgacggaaaggttttatggacaagtatccgtgtggaaaatgatacgttagtgacaggatatcgtataaccaacggctgggcacggaccaattatacctatttcgccatgtctttctccaaaccggttatccattacggatgcgatgaaaaagcaaaagtagattaccgcggcggttacggcaagtttaatatgaaagagaactttccggatataggcggtcggaagatcgttgcttatttcgatttcgatcctgcttcttcggatgaactggaagtaaaagtagccctttccggtgtaagtaccgatggcgctttgaaaaacctgcatgccgaggctaccggatatagttttgaccaactggcttcacgtgctgcggatacctggaataaggagctttctattatcgatgcgaaaggttctgacgatcagatggcgatgctttatacctctctataccatacgatgatcaatccttgtgtctacaccgatgtagatggtcagtatcgtggtctggatggtaatattcataaagcagacgatttcactaattacacggtcttctctgtttgggatacgtaccgggctttgcatccgctgttcaatatcatcaaccgtcaggtgaataccgatattgcccgttccatgctgaaacattgcgaacaaagcgtacataaggcgttgcctgtatggagccatatggcaaacgagaactggtgtatgatcggttatcactctgtatccgtattggctgatgccgtggcaaaaggcttgccgctggataaggaggaagtgttgaaagcaatggtcagcagctctaccattccttattatgacggaacgaaagaattaatggaaaaaggatatgtatccctcgaccgtagtggcagtgccgcttcgttgacactggagtattcttacgacgactggacgatttacaatacagcccttctggcaggtaatcgtgaagttgccgaccgttataaaaagcgggccatgaactatactaatgtattcgacaccagtatcggttatgctcgtccccgttattccgacggacgctggaaagagaacttcaacctgctgagcacacatggtgaaggttttatcgaaggtaatggcttgaactattcgttctatgttcctcaggatgtaaacaatatgatccgattgatgggtggcgacaagtcattcatcactaaactggactctctctttaccatgcacctgcccgacgaattcttcgctgaaacggaagatgttaccaaagaaggtcttctgggtggttatgtgcatggcaacgaaccgagtcatcatatcccattcctgtatatgtggactacacaaccctggaaaacccagtactggcaacgtgagatcatgaacaagatgtaccgtaacaatatcgacggcctgtgcggtaacgacgattgcggccagatgtctgcctggtatatcctgtcggcgatgggcttctatcctgtttgtccgggaaccgatcaatatgtattgggtgccccttatctgccttacatgaaagtatctcttgaaaacggaaagacattcgaagtcagagccgacaaggtaagcgacaagaaccgttacgtcaaatccgtaaaactgaacgggaaaccttataccaaagcgtatattactcaacaagatataatgaacgggggagagctgaccttcgaaatgacatctgctccaaacaagaagcgtgtctttgccgaagctgacaaaccttattctttatcatcaaattaaaataacatatattagaccatgaagagactatttgttttagctattgctctttgcggcagcttgttttcgatgaaagctgctgcaaaggcagacctcgtggattacgtaaatccgttggttggttctcaatccaaacactccctgtcgacaggaaatacctatccggctatcgctatgccgtggggtatgaatttctggatgccgcaaaccggaaagatgggcgacggctgggcatatacctatgatgccgataagatacgcggttttaaacaaacccaccaacccagcccgtggatcaacgattacggccagttctccattatgccgataaccggtaaagtggtgttcgaccaggataagcgtgccagctggttttcccacaaggcagaagttgccaaaccgaactattaccgtgtgtatctggccgatcatgatgtggtgacggagattgcgccgacagaacgtgccgccatgttccgtttcactttccctgaaactgataaatcgtatgtgatcgtcgatgcattcgaccgcggctcttacatcaggatcatcccggaagagaacaagatcatcggctatacgacccgtaacagtggtggtgtaccggagaatttcaagaattactttgtggttgttttcgataaaccttttacctataaggcaacggttggcgacaacgaaatccgtaaaggtgaaaccgaagctcaggaagatcataccggagcgattatcggtttctctacccgtcgcggcgaacttgttcatgcccgtgtcgcttcttctttcatcagtcctgaacaagctgaacagaacctgaaagagttgggcgaccgttctttcgatcagattgcagatgccggtcgcaagacatggaacgaagtattgggacgtatacaggtgaatgacgagaatatcgacaagttgcgtacattctactcttgcctgtaccgctcggttcttttcccccgtagcttctatgaagtggatgccaatggaaacgtaatgcattatagtccgtataacggtgaagtgttgtctggctatatgtttactgataccggtttctgggataccttccgttgtctgttcccgttccttaacctggtctatccgtcgatgaatgtgaagatgcaggaagggctggcgaatacttataaggaaagtggtttccttccggagtgggcgagccccggtcatcgtggctgtatggtgggtaacaactctgcttctgttgttgcagatgcttatctgaaaggcttacgtggttacgatatcgaaacgctttgggaagctgttgtacatggtgcgaacaatgtacatccgaaagtatcatctaccggccgtctgggttacgactattataacaaactgggttatgtgccttacaatgtgaagatcaacgaaagtgccgcccgtacattagaatatgcatacgacgattggacgatctataaattaggaaaagcactcggtaaaccggagtctgaaatagcgatctttgccaaacatgcgatgaactataagaacctgtttgaccccgaaaccaaattgatgcgtggacgtaacgaggatggtacattccagtctccgttcaatccgttgaagtggggtgatgctttcaccgaaggaaacagctggcattatacttggtcggtattccacgatcctcagggattgatcgacttgatgggaggaaagtccggctttaatgcaatgatggattctgtattcaatgtgccgccattgttcgacgatagctattacggtggtgttatccatgagatccgtgagatgcagatcatgaatatgggtaactatgcacatggtaaccagccgatacagcacatgatctatctgtataactactccggtgaaccctggaaagcacagtattgggtacgtgaggtgatggacaaactttatttcgcaactcccgacggctattgcggtgacgaagataacggccagacttctgcctggtatgtgttctctgccctcggcttctatccggtttgtccgggaactgaccagtatatccttggttccccgttgttcaagagcgtaacgttgaatctggaaaacggtaagaaggtcgtaatcaacgctgccaacaacaatgcagacaaccgctacatctcttccatgaaggtaaacggcaagaattacacccgtaattacctgacccatgaagacctgttgcgtggtatgacgatcaattgcaccatgtccgctactccgaacaaaaaccgtggcacggaggaaaaggatgcaccttattcattctcaaaagaaataaattaaacctacttttggcttgatccaaaagtagtcaaaactcttgtgattgccgataccgacacctatataacaaacgcttttggttttaacaggtagtatcggccatcctaagaggaagcaaagcttccttggaaaggcctcagcgggtgagcgtccgcgaaggggaaagacgaagcggctcggaaaaatccgttgtttgagcgaagcgagtttcggatttttcaagcgtagtctttcaccgtagcagcgaagccggtgcagccttgaacttttgattacttttctttcaagagaaaagtaatgattaaagatatgaaacaacgaatatacaccttactcgctatttcctgttttgttctgaccactacagcccagaatgagaaactgacagattacgtcagacctctggttggaacagacggttacgggaatgtctaccccggtgcacagattccgttcggcggtatccagatcagtccggatacagactctaaatattacgatgcggcagccggttataaatacaaccatacttccatcctcggtttcagtctgacgcacctgagcggaacgggtatccccgatctgggcgactttctgtttatacccggtaccggcgaaatgaaactcgacccgggaacccgcgaaaaccccgatgaaggttatcgctcgcgttacacccatgaccaggaatggacttctcccaattactatgccgtcctgttacaggattacggtgtgaaagccgaaatgacagccgggctgcgtagcggaatgttccgtttcacctatcccaaatcggacaagtctttcatcatgatcgacctgaatcatacgttgtggcaatcctgcgaatggtctaacctccgtgttgagaacgattcgaccctgaccggctacaaactggtcaaaggctggggaccggagcgccatgtctatttcaccgctgtcttctccaaaaagctgaaagacttccgcatcatgcaggacaagaagccggttatttacaatacctcccgtttcagaagcacaaacgaagcctggggaaagaacctgatggcttgtctttcctttgaaacggaagccggtgaagaagtcattgtaaaaacttctgtctccgcagtcagcaccgacggtgccaaactgaatatgcaggaactgaacggcattaccttcgacggcctgaaagaaaaaggtatcggcttatgggaacaggaactggaaaagtatcgcgtgacagccgaccggaagacaaaagagacattctatacttctgcttatcatgccgctttgcatccttttatcttccaggatgccgacggtagtttcagaggtctggataagaatatcgaacaagccgaaggctttacgaattatacgactttctctttgtgggacacctatcgcgccttgcatccctggttcaacctggttcatcaggatgtgaacgccgatatagccaattccatgctcgcccattacgataaaagtacggagcgcatgcttccgatctggtctttctacggcaacgaaacctggtgtatgatcggttaccatgctgtttccgtcctggccgatatgatcgtgaaaggtgtcaaaggattcgattacgaacgggcgtacgaagctatgaagacaaccgcaatgaataagcattacgattgcctgcccgattacgaccgtaacggttatgtccctttcgataaagaagccgagtcggtttccaaaacattggagtatgcctacgacgattattgtattgcccgcgctgcccaggctttgggaaagacggacgattatacctatttcctgaatcgttccctctcttatcagactttgatagatccggaaaccaaatacatgcgtggccgcgacagtcagggaaactggcgtaccccgtttgccccgatcgcttatcaggggccgggatcggtgaatggctggggcgatatcaccgaaggctttacgatgcagtacacctggaccgttccgcatgacgtacagggctatatcaacctggcgggaaagaaactgttcgagaaacggctggatgaactctttactgtcgagttgccggacgatataccgggagcccacgacattcagggacgcatcggtggttactggcacggcaacgagccttgccatcatgtcgcttatctgtataattacctgggtaagccgtggaaatgccagaaatgggtacgtgaaatagtcgaccgtttctatggcaacgaccccggttctctaagcggtaacgatgattgcggccagatgtcggcctggtatatgtttaactgtgcaggcttttacccggttgccccgtccagtaatatatataatgtaggttcaccttgtgtcgaggcactgaccattgccatgagcaacggtaaagagatccgcatgacaaccgaaaactggtcgaaagacaacgtgtacgtcaaggaattgtatgtgaacggaaagaaatacaacaaatcgtatctgacatacgacgatgtgcaatccggtataaccctgcatttcgtcatgagcgacaagccgaattacaaacgtgctgtctcagccgatgcctatccggcttctttgtccttacccggcaaaacaatgctctatcagaaacctgtcggcaaataactttctaatcattaggataattaagtaacgacgagagtaacttttcccctctccgagagggggcagggggtgtgtgatctttctttcatgcacccctttcttccagcttctcccgttcttttttcgtcaggcttccgaccacgatctcatacgatttcttcaccagctctttaatcttctgatccggtacatcctgattgaaatggacactgatccaatacttcttgttcatgtgccatccgggcgtaatgccagcatactttccttgcagttctcccgattcatccgggttgcatttgatacaacagaaatcaaagatttcgatatttacaaagcaaaaccatttgtccgcaatatagaaacacaagacgtcccgactgtatttatccgccacattcgtaaacggcatcttctcatgcactcctttcaatgaaaggcagtattctctgaactcttcgatattcataatcctgattaattagaactacacaaagtttgcaaaatatattcaagtctgaaagttacaagtctgttagacagtgttattgtgtattactctgctcttcgtactccttaatttttgcagtacaaattagcttcgtaatatctctaagtgattcgactttaggaacaagcgcatcaatgtcctctttagtgacaacaaagtacggattataccgtgcttccacataagcagacttgagtaaagtaaaaagacgtttctcttcaagagtatcttgtggaaaaactgttgctaagtcctctgaataccttttcgttgcggatgagagtttagagaggttgtgttgcttattatttcgcaaagtaaacgttaaacggatagcataatagtaattctcacaggcttgatgtaacaagaaagatcccattttataatattcttctttataaatgagctttgctgtatgtaaaaactcatttgcagattgaaacttttcatcaaaatattcttgtgcctgttcttttatctctgcataattaagttttcttctacgggctaatttgtatttcccactattatacagaactattccttcttgcttgatttgtgtatagaagtatcgtccctcttcaaggtacttatttaatagtttgatatcatcgttgataaactgaacaggtgtatcccgatcaaagtcttttcctgcaaagaatatatcttctacattatccagaacggtctccgcctttttgctgttgatgccgcttgttattacataaatatcataatcggatattttgacggtagggatgccgccgtcttctattcttacgctacgacgcacatagttccctcttgcatagctaccaaaaagaataataaactcagtttgaggtaatctttttaatatctctttaaccagaaaattcaattctgcctgtttgtcttttggtagataagctattgagtctttcattatgctttatgttatgtacaatgttaaagtaacaaaagtacaaaaaatgaaatagagtttaacggttgcctttggatttatagtgacggataataatcaggctacttttcctgtagctaattctctttcgagatactcatatacataagctgtgctttgactgtagagtcctgtgttaaggttgattagtcgtgcgtatgtatctgatgtgtagagtgtgcggagtgcctcatctatatccatctgatgttcttgtatcagcagccatacgatttccttggaaatctcttctatcataaatgtctctttcgtcataatgtattcttttttgtcagatacttaatagctctttctgtgccgaagaaatactgtatggttacacctttcatgtacttcagttcatcgaggaatttattcatatctatcagtccggaagtaaagcggcgtatctgatagcctacagcatcattggctatgggaccgattacaatatcataacagtgtgacgacacacgtgtacggttacggcggttcatcaatacaaactctgcccattccctgctatattcttgaaactctagtactgataaattggagttatgaagacaactgtcatcaaatctatatgtattcagtgtgggaatacctattccttactgctcggtctttctttcggccaattccatagcttgcgctttgtctgctgaaagataaaaaccgcagccgaagtcttttcctactttagatatcgcaaggtctatttccgcaatatcaatattagaaccgtggtatagtatcatatcaacgctcctcctttcctgtggcaataggctgtaaggtcctctactacgtcttcaaacggaagtgtatgttccacattgtagaaacggtttacaaagtcaatgcctttgaacctttccagatagcgataggcctgtgatgtattgagcgaatgagctgcggcaaactcgcttattacggcgataatgtattctatcttgtttttaagctccgaatctgtattattcatctttcgtgctgtttttaagttacatcaagtacaaagatatatcttttttggaagtttcgcaatgcttacacatagtctgaaagcttatttctctccctcttcctgcggcaatgaatacaccctgtgtgtccggtatcccatctggatcactattccatccttcgtaaactgtttcatatcctccgtagcccggtagcggctgcaaccgttcagcgaggcataatccgtcagattgatatacggattgttttgcaggtatctgagcattttctttttccggtcttcctgttcgttggaagtaacattttctcttttgacttttatcggtcgctccttgttgaccaatgctttcagtcgtttggaacaacggaagtttaccccgtccgccctcgcaaagaagacagtccggcctttctcatctgttttctgtaacgttttgagggcaggggagaagtgcccgaacccctctagttccacacaatatccatgtgataaattcctgcctatataagtggtcaatgcttcgatcactccttttatatccgctgaggtaagcgaacttgaatccgaaagatattcacaaatctcttccatcctcatggtccctttggatataaggcgggcgcaagcttgttgttctgtcccattcccttttggagtcttatatactccgaattttattctccccatactagtgtcaattaatcgttatctatttctataattactcggacttatctttgattatgtccgatcttatcgtgtttttctgccgatgaaagttgttgccgacgccctcggcaatattgttgaggacgtcggcaaagctgtcgaggacgtcgtttattttgccgagggcgtcggcaacaacttagctgccttccaaagatagctaacattgggacggaaagcaagaaagacaaggtttattttgtttttgtccgaggtaattaccatatcttcccaggatgatgtatttttgtatcaccataaaaaagattaccatgatgacattatctaattttgagtattatgtacttccccggatatgggaacgtggagtttcttattataggcagggggctgtggaaagtttggaagaggagtttcctgacgaatggaatgcgactgtccggggaacagaggagtatacagtagagataactctggaagatgacaagattatggattatttctgtgattgcccttatgatggagatatgtgtaagcatgtggttgctactcttttagctgtcagggcaaggaagaagaccggacaagctttttatgcaaatggaaaagaatatgaaaagaagtctctttcttctgatgatatggatgctgtcagaacggaaataaaccagatattggcctttgtcgatggtaaggaactaatctcgtttcttcaggaatatgccgtttcttttgtagagttcaggaatgccttgaagcagcggtttgcaataaagccgaatatggacaggctcgataggtaagcattttgaagaggattggcgataatgattattttattcttacaaatgattgttgcagggcggaggaataccttatggcactggggaaagataagagtgttccgcaatctttaaaggatagcatattgaaatcattggaagagctgtgtcgttttgccacttataaagaaaattacatatatgatatgcctgaccttaaagaagcttttgagatggaggcgttaccgttaccgaaagtactggaacgagtagaaaaagagttggtaaaaaagaatgaagttggtgctgatatcgaggttcttgtaatgaaaaagattgacctgcttaataggatgaatcgtagtaatgatgcggaagctacaactctccgttatcttttcttgccaagtgtaagaaatatgagggtcgacaatttgattgatgatgaaaagtttgaagaagctttgctggtcttggatgagggtatatataaggaaatgcaaggcgggcgatcattttatgtatatgactggatggataagaaattgaggatatatcaaagtatacaggatgttcccaatgttataaatactgctaaatgtttatttatcgaaaagaaaggtgatttggattattaccggctgttaaaacaatcggtaccggcagaagaatggggaactttctataatgagttgattacgcaaaccccttttccttcggcttactggtcttcttctatagaagctgatatttatgtggaagaagaagatcgtgtccggttggtgaactttctgaggcgaaagtcatcattggatattttattgaactactctcattatttaaaagatgattatcccgaggatttattagaacgttttagttcactgattcaagcgtatgcagataagagttcggataggtcacagtatgaatatgttgcaaaggcactgagagaactgctgaaactgaaaggaggagaaaaggaagtatgccttcttgtagatgttttccgtcaggcatataagcggagaagggctatgatggagatattgaaggatttctaaccggtttttcgataaatctcaatatttttgtagataaaatttttacttgaaatcattatgtccgatcggataagtagtaattctgaatggaagcatggaggttctgaaattgatttcaggccaattcaggagaatcggttgattagggagtaaaatatttttcttgtatttataatagtttcagccctttggctatccggcatgcctcgatggaattgctaacgtgcagtttttccaggatattctgccgatgcctgtttaccgtatttatgctgatcgagagggtggaagcaatctctttgctcatcatgccctgttctattagctgtagaatctctctttctcttacggataaaatatcgttataagtctgtttctgcagttcaaggatttgtccgtcggcggagttgatgatggcactgtctaaagacggatcgactgtcaggttgtaaagacataaagataaccggatgctgccgttggattggctggcgatgtagaacattctgtgcagtacatggatatatttgtcggtattatcacgcatccggatatgactgacgatatgatagtcggcacgttccttttccggaatacttttcagaaagtgcaggaaccggagttcctgcaggtgtttttccaacaggtcgtcgggatggatacggctgaatatctcttcttcccagatcgagtggatcgttatgttggagcctcgttcggtcagccccagcttctctgccattcctccgtagtagatatggctcgtgttcgttttcatgtcacttagtactgcgatcgaattttcaatctgtgcatacgtggatgcgatcagtttacattcattgagccggttcgatacctgttgctcttctgtgaatgtctgtttcagtaattcgtcgttcagtttgtttacgatatccatatctgacgggtagaatggttattaatcagtattgcatgtttatcggtaagcgtctacctttgcaaaggtaaataaaatgtatgaaaacaatgaagaaaataatcttaggcgtattcgccttactggcaatggaaacaacatcggcacagacactcgaaaagatgcagtggttcaacgaacctgcacaatgggagatcaaggataagactttgtccatgtttgtcaccccgcaaagcgattattggcgtatctcccattatggatttaccgtcgacgatgcgcctttctattatgcgacttatggcggcgagtttgaagccaaagtgaagatcacgggcgattataaggagcgtttcgatcaggcggggctgatgctgcgtatagaccatgagaattatatcaaggccggtatcgaatttgtagacggtaaattcaatctgagcacggtcgttacccataagaccagcgactggagtgtgataacattggataaacctgtcccttatatctggatcaaggcggtcagacggttggatgcagtcgaaatattctactccttcgacgacaagacttacaccatgatgcgaaatgcctggttgcaggataatacgccggtaaaggtcggctttatgggtgcttgtcccgacgggaacggttttaatgtaaagttcgaacatttccaggtaaagcatttgcctgatctgcgcagattggagtggctgaagaaaaatgcggaataaacctctgtgtacttctttcacgattaaagaaaaaattctatatttgcaccgcttttaggagtaaatcagataatttctatataaatcagattaagaaatgacaaagagcgcattacaaattgcaagagcagcttaccagcctaaggttcccgctgcattgaaaggtgctgtaaaagccgttgacggcgagtatacagaatcagtagccgatcaggatgatatcaaaaaactattccctaacacgtacgggatgccgatcgttactttcgaaaagagcagcgaaaagaaaaatatgcctgctatcaatgtaggtgtgatcctgtcaggtggtcaggctcctggtggtcataacgtgattgccggtatcttcgacggtgtaaaagctacaaacaaagactctcgtctgtatggctttatcctgggtcctggtggtctgatcgatcacaaatatatggagctgacggctgatattatcgatgaatatcgtaatacaggcggtttcgatatgatcggttcaggtcgtactaaactggaaacaaaagaacagttcgacaaaggtcttgaaatcctgaaagaactgggtatctctgctctggttattatcggtggtgacgactcaaatacaaatgcttgcgtattggctgaatattacaaagctatcaacgctggtgtacaggttatcggttgcccgaagacgatcgacggtgacttgaagaacgaacagattgaaacttctttcggtttcgatactgcttgtaaggtatattctgaagtgatcggtaacatccaacgcgactgtaactcagctcagaaatactggcacttcatcaaattgatgggccgttcagcttctcacatcgcactggaatgtgctttgcagactcagccgaatgtggctatcgtttcagaagaagtagaagctaagaatatgtctttggacgatatcgtaacttatgttgctgaaatcgtagcaaaacgtgcagaggctggtaacaacttcggtacggtattgatccctgaaggtctgatcgaattcgttccggctatgaaacgtttgatcgctgaattgaacgacttcctggctaaacacgatgcagaattcaagatgatcaagaagagcgaacagcgtgcttatatcatcagcaaactgacaaaagaaaactctgacctgtatgcttctctgccggaaggcgttgcacgtcagctgtctttggatcgcgacccgcacggaaacgttcaggtttctctgatcgaaacagaaaagttgttgtctgaaatggtaggcaagaaattggacgaatggaagaaagccggtaaatataacggtaagttctctgctttgcaccacttcttcggttacgaaggccgttgcgctgctccgtctaactacgatgctgactactgctattctttaggttacacagcttcttgcctgatcgctgccggtaagactggttatatgtcatctgttcgtaatacgactgctcctgctgacaagtggatcgccggtggtattcctgtaacaatgatgatgaacatggaaaaacgtcatggcgaaatgaaaccggttatccagaaagctttggtgaaactggacggtgctcctttcaagaagttcgctgctaaccgcgacgaatgggcattgactaccagctacgtttatccgggtccgatccagtacttcggtccgacagaagtttgcgacgaaccgactaagacgttgcagttggaacaggctaaataattagtcaggaaatatagtatatataatagaggtaaggcgcaagttttacctctgtttttttagttgcgcattatatgctgacattgatcgagtaatcgctcagtggttcttcgcctgcttgtttcagtactctgttagccttcttgagacaaatatcattaaagtctttttccatgcagatgaaattatggcgcacatacttggagtctactgggataatcttcatatttagaaggtcaatgtcaataatctgttcttttaaatcctttttgttgatacttccggatacatactgcagaaatgcagacaaagcaattagtaaagtctgaattattggaagaggcactttgcgataatgatataaatggcgataaaatgaaattaccatggagcgtgtattttcatcgtagctttctagcaaagactgatattcctgataatcgtcaagcaaatcatcgactaactggttcttatcgtacaaaagttttgcgggagcaacatttatcccggttacctgttcgaatttgtcggcaatgaattctgcatctttatatgttatattagtatttgtacaattcttttttacttggatggagtcgaaaagtgaatatccggtcaataaagtatacattagcatcgctctgccacatatcgggtgagccatcattgattgagaaagttgatcaatctgattttgtgttgttttcatataatagttgttttattaatattaatatgaagacaatgtacaaaatatagttgacttacgatagaattttcatcaatatattcatattatatcgtttggtagttccggtaatcagaaaccagtcgacgagccaccaaattcctaatccgcctcctgtgagaagtttaccgatccctttgccgatgttcccgatcagaaaacggtctactccaagcattccgaggaaaatagagataagtaacatttttcctggctttttgaaatgagttgtttccagaataatctctttttcaggcgtgaggttaagtagccgatggataggaatttcatattcaggaaatttactttcattcgccagaagaaatttatcgactttgtttgcttccatattattttcagtcggtttatgaatatgatgcaaatatagttatttcctgtgttatttacagttctttattgatattccatatccagttgagaatagtcaggagaataatggaagcgaggatgtatttgttcatgagatgtcgctccgctcttttcagccaactctggaattgatttttttttcggataaagtctatcgtcatgccggtaagatagatggctgtcagtagaacgagtaataagccatacggattgatcagaatggagtcgtagatgtttccatttaataagacgagaagtgcgcggcgtgttccgcaggcaggacagggatatccggtggttgtgtggaatatgcagggaaatacagataatgcatatccggccattatgattatggcaagatatgcatatttatttcttgttcccacaatgagggcagaagttaaaacattaatatgttttgcaactgttccagattcttcctttttgttgcatccatgataaggaaccagtcgataatacaccagataccgcaaccacctaaagtgactaacttaccgacacccaggccgacgtcaccgataaggaaacggtctatgccgagagaacccaggaatacggaaataataagtattactgtcgggtctttaaaatcacaagtttgcagataaatcagtttggattcatccatagcgagtaggcggtctcttataatagatatatgactgctaggtagtttgctactgtttgtcaggaggaacaagtccactttctgtgcgtccattttttatagattgaattactaacgacaaatatagtaaaattccgtatctttgaacctgataatattaatttaaacaacacattactatgttctcaggaattgtagaagaagctgcccaggtagttgcgttgaaggtagagcagggaaatctgcatatcacaatgaaatgttcgtttgtaaatgaactgaaaattgatcagagtgtggcacataacggcgtatgccttacggttgtaagtctgaccgacgatacatatacggtgactgctattcaggaaacgctggatcgttcgaatcttggtttactgaaagtaggtgatctggtaaatcttgaacgaagcatgatgatgaacgggcgtttggacggtcatatcgtgcagggacatgtggatcagactgctgtatgtaaagatgtacgcgaggcggatggtagctggtattatacatttgaatatacgttcgacaaggcaatggcgcagcaagggtatatgacagtggaaaaaggttccgtttgtgtgaacggcgtcagcctgaccgtttgtaactcgcagcaaaatagctttgaagtggctattattccttatacacatgataatacgaacttctgccggatcgaaaaaggcacggtagtcaatctggaatttgatattgtaggtaaatacatcagcaaaatgatgcagttcaaatgaaaggtttcctctcatttgccagataacgcagagcgaccgggcattcgatccggtcgctttgttattttacgacacatcttttcttccatagatccatcttataatagatataagtgatgacaaatccaatggcgatactgattccgatagcccaccagatcccttgtcgtccgtaccatgcgcttagctggtaggcgagtgggatacggatcagccacaggcatagtaaactggttaccattgtgaagattgtatctcctgctccccggagtgcaccgttatatatattcagtgcaccgtgcacgataaagaatcctcctataatcagtaaatattcttttccgatagcgattacagcctggtcgctggtaaaagcccgcatcatttcttctccgaaaaagtaaatggctgtaaatgtaatcaggctgaatatgagattgaccagcatggtaaatcgtaaccctttgcggacacggtcgaaatggccggctccgatattttgtccgcagaaagcagccagtgcacccgataaggtgagaacggcctgtgttatgattgtatcgattttacctgcagctccataggctgtcagcgtgtcggttccaaaactattgacaattccaagcaaggcaatcaagcccagggcaattgcacattgttgaacactagtgggaagtcctattttcaatccttccttaaagagtttcatatcaaatagcaagtcttgttttttgatcgagagtaggggatgcgtattatttacatatcctaaagcgatacacattccgattccttgtgcaatgacggttgcgcgtgccgctccttcaattccccacttaaaaccgacgatgaataataaatccaaaacgatattcagtacggtggtaataaatatgaagatcatcggccggacggattcgcctacccctctcaatatggagattatactgttgaatgtgacgaagagaaaagttcctccgatatatattctgaaataagcaacagcgtctggtatgacttcctccggtgtattggtcaggcggaaaataggctcggcaaagatgatcccggctattgaaagagcgattccggctacaagcatgaaaataaagaaagaggagaaggcgcgttgaactttatcgtattgttttgctccgaaaaactgtgaaacgacaacggatgttccgcttccgactccgatcaccaatgaaatgatgaagtaataaataaagaaggaggcggaaacggctgcaagcgcttcttttcccagaaattgtccgacgataatactgtcggttacattatataactgttgcagcaggttaccgatgagtagtgggagtgcgaagcgtacgatcactttccatactggaccatgtgtcaggtcgtggttcataagtctttaagcaggatattattgttcgctttaatcatatcttctcttgttttgagcaaggtatgccattcttttgtgaacaggcaggatgtgtcgatcttaaagttctcggaaccgtattcatccatctttgtcaacaggtaacttacactgatcttatttacatcaatggctggttgatagtagactacccgttcgtcattttcataattgacttctatgataatatgaagttcggtaagcagataaagtatttccgttgttatccggatggggatgcgataatcgtcagacagttcatcggcagtatatggcctttctcccttcacaaagcgttttacgatcagagaggcgatcaataaggttaggaagtctttatatcgtcggctgatgtttttactatctcgttcaaaactgaatttctttacattctgagaagcataagatagttctgctccaaagaggcagattaaccaggataactgtaaccataataataataatggtaaggcagcgaagctaccatagatagcattgtatttgttaacccatatctgcccactgatataaatgaactggaaaaattggaaagcggaacctgccagtatgccggcaacaagtccgtttacaaatttcacctttgtattggggagtgaaacatacaaggctgtgaataccattattgtgattatgaacggagcgatattcaggaagaactctaccaaaggagtgaagaacacatagctgcttaagaatgagttttgaagcgtagacataaatatggacagaccgcttgaagctgtcattaataccggtaatatcaggaataaagccaggtaatcggagactttccggtgccatggacgcgacttttggatttgccagatatcgttgaatgtatcttctatggacgaaatcaggttaatgactgtgtagaataaaaggataagaccgactccgataatgactccgccttgtgcttgcgccagatatctttctacgaacttaaaggcttcgcttaattcttgttcttgtcggggaaaataatcgaatagttcctgttgtactgcttcctgaaatccgaagcctttggcaatacctaataatactgccagtaggggaacaatagccaacaatgtactgtaggtaagagcggaagctttcgtttgaaggttctcgttattgaatccgcgtatggccagtatgactgtcttgatcgtatttatatatatttctttcaggccgcttacttcattttctgtaattcgccagatgtcgtaagtaacaaaatgaatggttcgtgtcagcaaggcgttgatccgttctcccagaggctttttttcagcagtctttttatccgtcttctttttcatgctgtgaaatgtaggggcaaagagtgtttgccggatgaataaaaaaatgcagcctgcctgtaagccgggttctgtactcccgtttgcacggaagcgtctgccatttatcttgtcttgctgtcaccagtaagctttagcggtctaccccccggcatcggacgagcaatcctacatgcgccggtatacatgaccttacaacccataagacgtacggcatcccgtattactacggcatccggtgagctcttacctcaccttttcacccttaccggacatatccggcggttattctctgttacgttactctaccctcacggacagcttcccgttaagaagtatggtgctctgtgttgcccggacgttcctctcacccgaaggtgagcgacagaccggcaggctgcaatgcgacaaagataggtattttagttgacagttgacggttggcggttgacatttttaggtaaagacaaggacagagtacttatcgagttgcttttggcttacttattaagtaaacgccggactacttaataactaatactactgactacttatcgagtagatgaatggcttcttaataagtagacgaatggcttcttttataaagaaaggagcactttccataaccagtcaactgtcacttgttagctgtcaactggaatgaactttctgccgttcttactgttatattactgaaagcatgaccatttggcaggggagtgattgttaaaaaggtactttgcaatacacagtactgttaagcgcagttaaccccggataaatcgccgttaaaagtgataaaaaatcaaagccaaatggaataatcgcacgttttttgaactttctttgtcgaaagaaaagtgttaaatttaaatgtttgataaaatagaaagagtatgaaaacaatgtggaaaaatgtgctaggagtcgttcttgttgctgccatcagtaccggtgctgcggttgggacaagtgcttatctgatgaataaaaaacaaccggtttatgtcactgattcaacaaatacatttaatcaacctgtccggtatgccggattgaatgcagtggctgctgaaaatacggattttactaaagcggcagaaagtacggtacatggggtagtgcatattaaagctacgacgaatgctaagcaatatgctgatgacggtagaggccagcagcagtatgttgatcctttcgaatacttcttcggatttggaggacgaggaggtggaggtttccagcgtccgcaaccacaaccccgcgtaggttctggttcgggtgtcattatttccacagatggatacattattacaaataaccatgtgatcgatggtgctgatgaattggaagtcacattgaatgacaaccgtaaatttccggcaaaattgattggaaccgatcctaccacggatattgctttaataaaagtagatgcaaaggatcttcctactataccgtttggtgattctgaaaaactgaaagtaggagagtgggtgttggctgtaggtaatccattcaatttaacctctactgttactgccggtatcgttagtgcaaaaggccgcggtatttctatgggaggtgacagaagtaaaattgaatcatttatccagactgatgctgctgtaaatcctggtaatagcggtggtgctttggtaaacacgaaaggtgaactgattggtatcaacacggctatttattcggaaacaggaaactttgccggatattcatttgccgtacctattagtattgcaggtaaagtggcaagcgatttgaaacaatatggaactgtacagcgtgctgttctgggtgttttgatgatgggcgtgggtgatattgccgagcagttgagttatcctaatctggatagtaaactgaaagaggaactgactgagttgaaatcgaagatcaaagtgtctgaaggtgcttgtgtatctgattttgctgatagaagttctgcaaaagaagccggtatcgaaaagggtgatgtgatcattgctgtaaatggagcaaaagtgaaaaatgcaaatgcattgcaggaacagatcagtaaataccgtcctggagataaggtagaagtcactgttgatcgtaatggaagtaataagacatttactgtagaacttcgtaatgcacaaggtagtacatctgttgtaaaaaatgcaggtgataatagtgcagatgttcttggagccgcttttaaagcgttgacggataaacaaaaacgtgaacttggtgtaagttatggtgttgaagtaaccggattattaaaaggtaaaatgaaagatgccggaatccagaaaggcttcattatcatgattgttaacgaccagaagatatctacacctgaacaactcgaaaagttggtagataaagtattgaaaggaaattctgatgatcgttacatcgttgtgaaaggtttttatccgaatggacgtacaaaagtttatgctattgatctagccgaataataaaataaagttatattcgtcttatttggcgggaagattgttaaaggtttataattggtcgggtgtagggtgcacacgaccaattttctcaataaaaataatattatctttgcaccctgatatttctcaattaaaaacattggatgagacagttaaagattacaaagtccattaccaatcgcgaaagtgcttcgcttgataagtatcttcaggaaataggccgcgaagatcttattacagttgaagaagaagtagaattggcacaggcaatcaaaagaggagaccgtagagcattggagaaattaaccagagcaaatctgcgtttcgtcgtttctgtggcaaagcaatatcaaaatcaggggcttagtttgcctgaccttattaatgaaggtaacctgggattgataaaagccgccgagaagtttgatgaaacgagagggtttaagtttatttcttatgccgtatggtggattcgtcagtctatcctgcaggctttggcagaacagtcaagaattgttcgtcttccgttgaatcaggttggctcgctgaataagatcagtaaagctttctctaaattcgaacaggaaaacgaacgtcgaccatctcccgaagaacttgcagacgagctggatattcctgtagataagatttcagatactctaaaggtgtccggaagacatatctcagtagatgccccgttcgtagagggcgaagacaatagtcttttggatgtgcttgtgaacgacgacgctcctatcgctgaccgatcgttgatgaacgagtcactggctaaagaaattgatcgagcacttgctacactgaccgaaagagaatgtgaaataatcaaaatgtttttcggtataggctgtcaggaaatgacattggaagagattggcgacaaatttggcctcactagagagcgcgtccgccagatcaaggaaaaagcaattagaagattaagacaaggaacacgtagcaagctcctcaaatcgtatttaggttaacctcgggtaaaaccaaagaggtaaacaaagctccatatccggaaggataaggagctttgtttttttactggtatggtttgtctatttctgaaatgaataagcaattatgattatcgtgttttctatataatatatgtgtattcgttttctcaggtttagagttcttttgttgttgattaattttttttccccgtaacattcagtgatacagaagtgtagtgattttgctgcgatattaagtaaaaaataaagtaagaaaagtttggagcgtatgttttataacactacttttgcatccgcattcgagagagaacggcactgcaaaacatgatgaaaaaacttttagaaaaaacttctgaaaacatttggaagtatgaaataaaagttcttatctttgcatccacgttcgctaaaaatctggcgaatgtaacaacaagagttctttgaaagatttacatatcaacaagtagtacaagtattaaaaaaccataagtatcccaacaatgcattagtacaacaggttcttcatatgacctggaggtcacacgaagacctctttagttttttttcggtaatcgttgagatataaggaataatatatgtatagttccacttcgcccattatcatttcttcttctccgcttgtaagcgaagcggaaggatagcaaggaactgtatatataaaagagctttctttgggggtagtagtcaatttctcaaatcctcttttctctataaaattatcaaccagttccaataccatagatgcgtcttttgcttcaaaacagcaaaagttcatatacaaagggatattatttttttcaaagttaaaaatagcaacgttgctggctatggtagtaacgacttccaaattagttaaaggaaatttcaatttgctcttttccttattaatgtcctcaaagggtttgagtaaatttattgtttcctctgtaatatcatcagtatctctaacaagtgtagagcctttatatgttatatgttcaaccttcatgcttatcgctttttatgcaaaagtagagaatttatatatatcatagatgatttcatttaactttttaaatatctgttaatctacaatttactttccatagtggaatttgtagattattctatgtatttattttcgctactatcggtttgttctcgtaaagcacgctttttagctttctcttttttcttcttttctttttttgctttgtcatctgcgataatgtcattcagagagcgaacagtaacaggttcttcccgtttaaaccgtttgatatatatcttcgataaactggggtaacggaactttccatgtttcctgtttatggttatctattttacctaatttatcgggatttagtcccaactcacgagccatctggacgtgcttatctgacaatttatgttttttttgggcaactacccatttttctatttttacaggcatattattgagatttcaagacaaaaatacctatttgttcaaatgtatgaaaacaaataggtttaaaaggctttttgttactttttcttccgttagattacttttactcatggaaaaccttaggtttgcattgtaattattttataaactataatgagtgaaccgtatggaaaaagagaaatgtaaagtctatgttactatttgggactcattttattcatttaatttcaagaatatttaatgatttacgttatgaattaagaagaaaggaaaataacaagtaaatcagcatggaaaataggaataacttatgttactataacgaacttgttatttgtcttggattagacctatataagaattttatctgaaagatatttaaggtttttaggatatattcaaatgcctttccaaattataaatcattaaatcactttattatgggaaactattattttattggaattgatgtgagtaaaaagaacttggattgttgcctcctgagtaatggtgtggtggtgaaacaagatgttatttcaaatcatcaaaagagtatcgaggactacttatctgtaatttgtgcagaacaaaatatagatgcagaacaaatagtagtatgtgctgaatttacaggattatatatttatcctttaacaatctcttgtcaagccggaaactataaactttggttagaagatcctactcaaataaaatacagttcagggttgcaacgaggaaaaaatgatcccgtagatgcaaagcgtattgctttatatgcctatcgttatatagataaacttaaaatatataaccacccaactataagtgttgaatcaataaagctattaacaacagaattaaatatgctatgtgttgatagagctaaataccaagctcaattatcagatcaaaaagaatatatgcctgatagagtctataaattgaagtcaaagagattatctctgcttattaaagaattagataaagcaatagctaatattgaagcggagattgaggatattgtagcaaaggatgctttattatctcatcagatgaaattattattgagcattgaaggaataggtaaaaaaacttctttaaaaatgatactggaaacacaaggctttacacgatttacagatagtcgtaaattctgttgccatgcgggtgttgctccattcagttattcatcaggaagtagtcagcattctaaaaatcgggtttcccatagagcaaataaaagtataaaatctttactccatttagcagccttatctgctattcaaaataagaatagtggattaagggtatattacgatagaaaagttgctgagggcaaaaataaaatgtcagtactaaatgctatcagagccaaactcgtagcccgcatgtttgccgtaataaagaataatgaactatacaactcaaattatactaatcagtttgttgtctgaaaaaactgttcgtatatttgcgaattaaaaaactattcgtatatttgcgaactataaaatgaagaagatggaaaaagtgaagaaaagatatacggttgagcaggtgcaaatggcacgtttcgccaaagccctttcgcatcctgtacggattgctattctgcaattgttagcaagtcaagaatgttgttatcatggagatatgtctgaagtgttaccagtagcgaaaagcactttatcgcaacatttgaatgaattaaaagatgccggtttgatacaaggtgaaattacattgccatctgttaagtattgcattaatcagaaaaactggtctttagcgaaaagattatttgaagctttattgactgaagtagaaatatcagacaattgttgtaatacataattttttatctttaaagttcgtatgtttgcgaacctacagacaattcgctttaaagcgaattgaatttttgataaacttattattatatatggaaaataaagaaattaaagaaatggtaaagcaaaaatacagcgcacttgctttacaaaatgataaccagtcgtcttgttgtggctctggatgctgttcctctgataatgtgtataacattatgaatgaggattacagtcagcttgacggctatgaagcagatgctgatttaggtctgggatgtggacttcctacagcttttgccggattaaaaaaaggcgattttgttgtggatttaggttccggggcaggaaatgattgttttgtagcccgcgctgaagtcggagaaacagggaaaatcatcggtattgattttacagatgctatgatagaaaaggcaagaaataacgcacaaaagagaggttttacaaatgtcactttccgcaaaggtgaaatagaagatatgcctattggtggtaattccgttgacgttgtaataagtaactgcgtattaaacctattaccaaccaaagataaaatcttccatgaaattttcagggttttaaaacccggtgggcatttctgcatctcggatgtggttttagaaggtgaattacctgaatccatcaaacaagtagcagaattatacgccggatgcattgcaggagcaattcctaaagaacaatatatggttaagattttcagtgcaggttttttacaggtgaaaatacaaagggaaaaacctatcgttgtccctgatgatatcctaaaagagcatcttgatgaaaaatcattccatgaatacaaggagaataattcaaagatattctctattacagtaacaggtgtaaaacctgaaagtgcttgcgattgtagttccggatgctgttaataatgttttgatatgaatgcacaaaaagttttaattctttgtacaggcaatagttgccgtagccaaatggcacatggcttcctgcaatctttcgaccctgcattaaaagtattctctgcagggacaaatgcaagcggaaaggttaatcccaaagccatagaagtaatgaaagaagccggagtagatatatccagccatacttccgatagtgtagataagtatctgaatgaagaatgggattatgtcattacggtttgtggtggggcaaatgaaaactgtcctacttttttcggtaaagtgaaaaaccgtttgcacataggatttgaagatccgtcagaagcaaaagggtcaccagaatttatccattcggaatatatccgggtacgggatgaaataaaagaagcattttataaattatacatagaaaaaataaaaggcaatgagtaagaagaaaatgagttttttagataagaatctcactctttggatattcctggcaatggctatcggggttgggctgggttactttttcccatctttcagcactacaatagattcattatccagtggaactacaaacatccctttagccatcggtttaatcttaatgatgtatccgccattggcaaaagtcgattataaacaattaccgaaggtttttaaggacgtaaaaatattatcagtttcgttaatcctgaattggattatcgggccgatattaatgtttgtacttgccatcatcttcttacacgattaccctgaatacatggtaggtgtaatccttatcggattagcgagatgtatagcaatggtgcttgtgtggaatgaccttgcggaaggaaatacggaatacggtgcaggtttagtagccctgaacagtatctttcaggtattcttttacagtttctatgcttggttgtttattacgaaacttcctccccttttcgggtttgaaggggctatcgttgatatttccatcggtacgattgccgaaacggttgctatatatttaggtattcctttcttaatgggaatattgagccgacttatattagtgaaattgaaaggagaacaatggtataaggaaaagtttatcccgaaaatatccccgataaccttaattgcactgttatttacaatcgttcttatgttcagcctgaaaggtgaattgattgtacaaataccaatggatgtggttcggatagccataccgttgcttatctactttgtcgtgatgttcctgcttagtttcttcgcaggtaagtttatgggggcttcttatgataaaaatgcttctattgctttcactgcaaccggaaacaactttgaactggctatcgcagtggcaatcggcgtattcggattacatagcggacaagcctttgccggagtagtcgggccattggtcgaagtcccggtattaatcctgttagtgaacttggctttttggcttcggaagaaatattataaataaacatagtacaaactaataaaaacacattgtatgaaaaaaagtattttaatcgggctttttgccatattgctggtagcctgtggtggtaatgcacaaaaaaacaacggacaagccactgaaacgcaagctaaagagcaagtagcggatgcttctgtggtgaacgtttactatttccacggtaaacaacgctgtaaaacctgtattgcggtaggcgatgtaacagagaagacaataaaagaactttatgcagacaatccacacgtgaaattcattgaagtaaaaaccgatgaaaaacaaaatgcttcactcgtagaaaaatatgaagtaacatggaatgcccttattattgccaaaggggataattccatagatattaccgacaaggcatttgccaacgctttgaatactcccgaaaacctcactgacctgatcaaaaccgaagtcaataaaagattatgatggagtttttacagaatcttgtggatggctctaactttccattactaacggcgtttcttttgggcttaatgactgcaatcagtccttgcccattggcaaccaacattacagctaccgcttatcttagtaaagatataggcgataagcgaagagtaatgtttaatggcgtattctatacactcggcagaatgtttacctatacggcacttggtttgattttctattttggagcaagtcagtttcaggtagctaaacttttgcagaatgttgggggaatgtggcttgggatagcattagtcattatcgggatattcatgttggacattattaaaataaaggttccgggaatgaataagctaacctcaaaaatagaaaacaagaaaggaaagaaaacctacctcgacgctttcctgctcggtttgctgtttgcattggctttttgcccttatagcggtgtattgtactttggtggattaatcccgatgactattgccagcccgtcagggttattacttccccctgtatttgccatagctaccgggttgcctgtaattatcattgcatggctgttggcatacagtgttagcaacgtaggcaaattctacaataagatgagtgtcttccagaaatggtttaaatggattgtcgctgccgtttttataatagtgggtatttactacataattacaagcatttaattagaaataacaatataagataaataatatggagattattgtattaggtacaggttgtgccaaatgtaaaacaacctatgaatctgtccggaaagtgttggcagataataacattgctgccgatttgaagaaggaagaaaatatacttgaaattatgaagtataacattatgtctttacctgcggttgttgttgatggagaagtaaagttgaaagggtatgttccgagtgaagaagaaataaagaaatccctgaatctataaaacatcacattatgagcagcacatggtatccgattattgattcggaaaaatgtacaggatgttccgcttgctttgaaaaatgcaagaaaggagtttatgcgatagaaaatgagaaaccagtagttgtatatcctgatggatgtgtaactggttgtcatggttgcgaacctctttgccctactgctgcaatcagttactttggtgatgcagcaacaatggattactgtaattgatagaattgtacgcattgaatagatgctgttttgaatcagatagcgtctatttttttaaccaaatagttcgctacattacgaacattgaataaatagaattaataacaaataaaatattaaaaatgaaaacaattaaaatttatgaccctgcattatgctgtcctaccgaattgtgcggagtgaatatcgaccctgagttgatgcgtatagcagttgtggttgaaacattgaaacaaaaaggaattatagttgaacgttttaacttgcgagaccatcctcaggtatatgtaaccacgaaggttgtcaatgattgccttatggcagaaggagcagacgtatttcctctaatcacagttgatggtgaaattgctataaaaaaggcgtatccatcaaataagcagattgcagaatggctcgatatttcagaagatgaactaacaataaaaaaataacccacatgaaaaagtataatccttcaaacgaaaaacttacccagtatatatttttcacgggtaaaggcggtgtaggcaaaacatctatcgcctgtgctacagctgtaagtcttgcagatagtggaaaaaaagtattgttgttgagtaccgacccggcatccaatttacaggatgtatttgatatgccgttagacaataaaggtactcccattaaagatgtaccccgcttgactgttgtaaaccttgaccccgaacaagcggctgccgaatacagggaatcggttatcgctccatatcggggtaaattacctgaaagtgtaattgctaatatggaagaacaactatccggttcatgcacagtagaggtcgcagcgttcaatgaattttctgattttatcactgacgaagataagagcaaaaactatgattatatcatttttgatacagccccaacaggtcatacactccgtatgttgcaacttccttctgcgtgggatacttttattgacgaaaatacgaccggagcttcgtgcttaggacaattatcaggtttggaagaccgcaaagatgtatataaacatgcggtaaaaaatctaaccgataagtctaaaacaacgctcttccttgtcagccgaccggaagacagcccgttgaaagaggtcgaacgttcatccaatgagttgtcggatataggtatcgaaacacagcatttaatcataaatggcgtattagaaaactacgatgcagacgatagtatttccaaacagatttatgaacaccagcaaaatgcgctgaataaccgttcggcagccttgctaaaactgaacacctatattgttccgcttcgttcttataacatgacaggcattgataatatccgtaatatgttgaatgcggatgtagccataaagaacgaaagtccggatattgagaaacgtagtttcaatacgattgacagcgttattgaagacctctacaaaacaggtaaacgggtgattttcacgatgggtaaaggcggtgtaggcaaaactaccattgccgggaatattgctcgtggtttggctaaaaaaggagtgaaagtgcatctgactacaactgaccctgcaaaccatttggcttatatcgaaacgaaaatagacggcatcacagtaagccatatagatgaaaaagcggtgcttgctgcctatcagaaaaatgtgcttgacaaagcaagggaaacaatgggtgatgctgatttaagttatatcgaagaagacctgcgttccccatgcacacaggaaattgccgttttcaattcctttgccgaaatagttgccaaagcggataatgaagtggttgtgatagatactgcaccaaccggacacacgttgctgctgctggattcaacccaaagttatcataaggaagtagaacggacacagggaaatatcacccctgcggttcaaaacctattacctcgcttgcgaagcgaaaaggaaacggaagtggttatcgtaaccctgccggaaacaacacctgtgtttgaagcacaaagactgcaacaggacttacaacgtgccagaattaagaataaatggtgggtggttaattccagtcttttgctgacttcaaccaatagtccattccttaaagctaaagcattaagtgaagtgcaatggattaataaagtgaaggagatttcagacgggaactttgccgttattgaatggaaggaaaaagtgtaatttagaacgatctgcaaattattctgaagaaaataaacgaataatttgcagatcttttaaaaatcttcgattttcatcaatcttttttattttaaattaatgatgatgtacatccatttttaaagaaaatcagacttttagcatatttagctgttaaaaattgactatcaaaatctttataaaattatgtaaggtgcttgtatcttcatgcaatgtaaatagtaaaaataaagcggataataaacgtattatgcaacctttttggcaagaaaattgtttaaataataacatagagtaatataaaaaaagaatcatgaaatcaacagaacaacctgagagcgcaatgtttttagaaaacgtaagccgttacagttatgacgaaaccttcgataaactatccgaaaaaatccagtctctcggaaactggaaaatacagcatattcatgatatgcaggaaacgcttcgcaaaaatgggaaagaagtgctaccgataaaagtcatagaattgtgcaaccccaaatattccggcagaatattggagcatgatatggaacgtctttattcatcattacttccatgtcgcatatctatatatcagacttctgatggtataacccgtatttcgcgcatgaattcggttgctatggcagcacaaatcggcggactggtagaggaagtaatgagcgaagcctttgctgaaattgaaaaagcaatagccgaaatagaatcgtaaattaaacagtagataatctgtgaaaatagtacgaaacttgcaactaagttgcaaaacataatcgctatctttgcagcatgaaatatttgtccctcatattatccatatatgtattactgttatcagtaatgccatgttgttttgaggataaatgtttagctatatatacagataccgttgaaacgagcaatgacataggcaatagttgtgacgactgttccgatgatagttgttgttccccttttctacattgtaatacctgttccggatttccggaagcccgtttttataatccaataataataattttaggctctatacctgattataaatcagattatatagtaaaaaacgctctctctgattataaatcttcaatctggcaaccgccaaaagcataaactaatttttattatacaggtcgttgtgaatatgccctgcaatttttacgataatacattctttgtaatatcgtaatcctcatatcatttatagttgaagatttaaaaacaagaaataaaatgaaaacaaaaattatactaatgctattcttagtattcagcatttccaatattttcgctcaaaatacacttaacgttaaactaatagactgtgataacaaagagcctttaatcggtgctaatattatacttcaaaatactacgaacggaacatcttctgatgctgaaggattagcggtactctccaatattccagacggtaaacagaggtttgaaattacttatgtaggatatgaaaagaccataaaagaatttacattcccgttggcttcggatgaacctatcgttatcagggttgagcctgatgaagaaacattgcaggaagtagttgtttcttcaacaagggggacacgtacttttaaagatattcctacccgtattgaatttataaatgccgaagagttaggcgaaaaaggagtgatgaaacccggagatatacgtatgcttctgaatgaaagcacgggtattatgacacaacaaacatcagccatatcgggtaattcatctattcgcattcaaggtttggacggtagatatacacagatactaaaagacggttttcccgtattttcaggtgcagcaagcggattaggtttattacagacaccaccgctcgatttaaagcaggttgaaataataaaaggttcttcttctactttatacggtggcggtgctattgcgggactggtaaaccttatatcgaaaacgcctgaaaaggaaagggatttctcaatccacctgaatgggacaacaggtaaagggcttgatgtaaacagctttttcggtcagaaattcaacaaggtaggtactaccgtttttgcatcgtataaccgtaactgggcttatgatccgtcagatgttggctttacggcaataccaaagttcgacaggtttgtatttaatcctaagctattcttgtacctgtctgaaaacacagattttaatttcggtataaactccatgattgaaaaccgtctgggtggtgatatggagtatgtaaaagataagggaaacgaagaacattcctattttgaaagaaacaagacacaaaggcattcaagccaacttacatttgaacatcgtttcgacaaacaaaacagattaaatgtaaagaacagcattacttatttcagccgtaagattgagattcccgatttcaaatttgacggcgaccagttatcgtctttttcagaagtatcttatatacatacaaaagaaaaaacggaatgggtagcgggtgcgaatgtgtggacggataagtttaccgaagaaaaactgaccgattttcctttacgtgattacaatatgactaccgtaggcgtatttgtacagaacaatacgaaaataacggactggatgaatcttgaaagcggattgcgtaccgattatattaacgattacggttttgcagttctaccccgtatatcttctcatttcaagataacggagaaattttcatcccgtgtaggtggtgggttcggatataaagcacctaccattttttcggaagatagcgaacgcatccagtttcagaatgtcttgccgatagatgacaacaggaacaaactggaaaggagttatggggcaaatgtggattttacttataaaacgggtttgttcggcgaccaagtatttttaagtataaaccagttattcttttatacttacctgaaaaatccgcttgaactgcaagctgctgaaaataatcgttggcagtttaataacattaacggtcacgtggatagtaaaggggctgaaaccaatatgaaaattaagtataaggatttcggtttatttctcggatatacctatacggatgctgatgtaaaggaagacggcagaagctaccaaaaaaccttaaccccgaaacataaaatcaattctgttttaatgtatgaggtggaagataaatggaaaatcggattggaagcttattataccggaaaacaaaatttgaatgacggtaaaacaggtaaggattaccttgtcttcggattaatgatgcaacgaatttgggaaaagttctcaatatatgctaactttgagaactttaccgacagacggcagacaaggtttgataccattcatacgggttcgatgactaatcctgaatttcgggacatttatgcaccgttggacggtttcatcctgaataccgggattataattaaattgtaaaatgaataaatcaatttttaaaattgaacaaatggattgtccgagtgaggaaaacctcattcggatgaaactccaaaatatagagggtgttgcaaagcaggaatttgacctgaaaggcaggatatttactgtttaccatacaggcgactatcaggaaatcgaaaagcagcttgctaccttgaatctcggttcacgctttattgaaagtaaagaagtaacaggagaagtccaggcagaggaaaatagcaaacagcgtaaagtcctttggattgtactggctattaacttcggctttttcctgattgaaatgtcaacgggtattatatccaaatctatgggattggttgctgatagccttgatatgcttgctgatgcttttgtttatggattaagtttgtttgcagtcggtgcagccgtaagccgtaagaagcgtgttgctatgatttgcggatatttccagatacttttggctgccgttggttttatagaggtaatcagacggtttacaggtacagaggaaatgcctgtttttcaaacaatgataggtatatccgtacttgctttgattgctaatgttatatgtttgcttttacttcaaaggacgaagagcaaagatgcccatattcaggcaagtatcatcttttcatccaacgatgtaataataaatgcaggggtaattcttgccggattcttagtatggcagttgaataatcagatacccgaccttattatcggtagtattgtattccttattgttataagaggggcaattaggatattgaaacttgctaaaaattaaataatgtcatttgatctgcaaattatttgtatattttctctcaaataatttgcagatctcataagaatagtaacgggcggaaaccgcgcgtctgtttattttatatcagctatattttatctgctgttttgtgggcagcatccccaaccgtcgtatttggcaccgtagtcattacccaatgttactaactcccatgtatattcgttaatctctgagggcatgacattgtttagccgggagatttgcaatgcgaaatgataggaatcgccatgatctacggtttcttttagcgccactttatatccgagcgtttcgacttcccgaataaactgctctcgcccttcttcggtcgggaaatagataaagtgatccacttccctttctttgctgaagtcgtcgccgtcctgatccagttggaataagaccgactggttttctatggtttgcagttcgtatttggatgggtacaacaagtcgaagtaggtattccaatccttgtctttctgcacttcaatgttgtacgagtattcgggatgtacattcatgacggactttaagagttcctcgcattcttttccgtgttttacataaaggtacatattcatcagaccgtttgacttaacgattcctgcgacgatgacatttttcttttcggtagcctcgatgatttcttcttggatgctgtgtagtacctcggattcttcttctgccgtgaataatccgttttcatctgcggagagcatctgaatagtaaatagcagcaactctttgaggttatctattggggctaagtctaccagcgcgaggttcatcaggacgttagcgggatgatcttcgatgtggctgaaataagcaacccattgttctggtatattgttggttttaattgattctgacatattgtataacttttattacggcgtgaatttaactaaaagattttaatactcactgtattaggataatctaaaaaatatttagtgatataatagctatcccgacggtgttccgtcgggattttttcgtgtataaagaggaaaattcaacgaatatctgtaccgaacatttcattgaagaacgctacaagttcctctcgacgcaggctatcccaatagagagaggcagggtgatacggttcgtgccgaccgatttcataggcaatatccatttttgtaaaacgcttgccctgattgtagcgcatttctgtaccttccaaccaacgtgaacgacggctttgttgttgaagcgggagcagttgttccaacatataggcataattttcgcctacggtgtgtccgctttccattttatacggactgtctttacaacgcttacattcgtcaatggcggcgttcaaatctgttacttcaattatgtttccatctatgtcttttattgttgtcatattctttgttatttagaggtttgtacttgcattgaggaaacataccaattatcttgatacttgtctccaatcaggttaaaagtacctgatagtccgctattatctgcgtatttcttggcttccattatagagctgaactcgcccaactttttgaatccaataaataatttatacatggtgctgttctgtttatgcttgatgacttctgcctgtaaaatggcatacgcttcattataatttttctttttctgttccaatttggctttggctttgagtaacttttcatccgtttcaagattgaaaaacaggtcattgtgtgtcatatagtcgatatatttggcgattgccctttctaccttagttatctgcgcttttgccgaagctactttgcctaaaaggaagtcaaaacctgtttgcaatcccgtccgcttgtcgtatgcacagtgatatacccaaattttcttacgggggtatttacataccaattttgccctgcgccactcaataacccaccgccaacggtctaacatggcacgagggatgtcgattatatgtagtatttcacggtttctgtcctcgtcccttacttcaaaggttatatatacccaatgttctattttgagttcccgttccgcttttgcaaggtctttggcatcttgcatccaatcgtctattttttcctgtgccatgatattgataattaactgttataaatttgctgtatttcttctccgatttttgacaacgcttgtcgttgttcatcggtaagtgatagtacaaaatcatcgttgctataccattctccgctatcttcttgttctcggaaacatcgcctgttagcagtatctacgattcccaatattacatcaacttcggttgaagttagtccgctaattgtgcaggtcttatttgttttatttactttcaatttcatgctttttgagattatgggcggattactccgccctttggttattcatatgcttcaatcctttcttttacaatctcatgtaagtgtgaattggattgataaattttgattttttcttgaaaggttttattttgccaaaattggttggcatcatcaaggaattttgcatctatttcattattgccgtctctgtcctgctctatacctgtaatatcttcaaattcatcaaaactaagccattgccaccacgtattaagagtttgcaaagaccattcattcggctttttgggactttcctcaaatgatctgacaaccgttttcaatttttgtccgtctgatacacttaattctttatccctgtccaaaagccagtacaggaaaaagatgatagtgtctttagatattatatgattgccattgaatagatttagcaaaacaacaggttctttttctttggctttcaatgcttcttcgcttgtggtataggcattttcaccgataccgaaacgtagggagttgtttacggtaaattctacctttccgtattcttccattttcctgtatatgaagtgttctaaatctcttatatcgtgtatcaggtcgaaagggtgcaaggcttccagttcttcttttaactggttgtgaatatcccttaacatgggttcaatggtaaaccatttagtagggttggttatctttcggcaagtggcaggatcgtgaacgtcatcgagaaataaaccattcttatcaagtgtgcaataacagtcatagcagaaatgcgtatgatattccgtttcgctctttttgatagacttatttatgattattcggatttgaccgttctgtaacagataaaaacggatgctccaacggtcagtttcaaaagctatttgataatgcttgctttcgcctgttaccctgttcaggaaatgtacaactcccttatacataattgctattttattcggtttcatattgattggatttattaaaagaatgataattctaattgtacaggtttacgccctgtaatctcgtcaaataaggctttcgcttgttttaatacattgattgcatatcggtcggtcttactgctgtctttttcaagtcctgtaagcatttcatttaatgctgctttcaggcagtcttttctattgtcgaatattttaccccatacattaagcccatagcctgatccgcctgtactgtgagagtaactcattccataagtccattttccgtttaagcctttacccagtgtgatatggttagataccgcccaaccgtcccgatgtgggaattgtatttcttcacgttccaaaaaatcaggtctttccaaccaaccgtattcgttaaattcctttttaatgaagccaaatactaaatgtctttcgtactctcgtttattcattaataactggcgaggggtatttccaaaactctcgtattcctctattatcgccctgtcgttacgtcttaatgcgttcagatatatagctacattgtggcgttctgccctgcaaaaattgatgtcctgtatcttttgcaatttttcgtatgctgacaattctctgtatttcatgactgttattttgtggggcagggttactgccccgtgtttgacttcttttatcttgcactcattgttatagttcctcgcagattgggtgagaacttttgttcataggcttcaatctgcctttcaagttcttcccatgcggttatttcttcatcatacatctgtaaatcggctttacattcttgtattagaattgtgaggtattctttttctatttcaatttgcttgattgcttcatccgcatttatcctgtcttgtgaattttcatcaggcttggttgttggcaggagaaaaacgcagttgtatgatgtcagataattccatgttttgccctccacacttgcatacattctgtgattattgtcagatataccgattgcaatgcctttacatcctcttttttcggtgatgctgtaagaaaggttgttcgggttctctgcggtgtatatggctttaattagctttgaattggctaccttgccattaaaggctctgataaacggctcacacgtttccaaaccttttataaggttctcatttactttaatttgttggttcattctattaatgaactcttgttttctattggggttctttaatccgtaatacatgatatattgttttttgattgttaattatttactgcgtcccattctcctttttggtcatcaaaccaaattgcatgatagaattggacggttacttttggcttctttcttgggttggcaaaggtttccgtttggctgactttccacccttttgcagtttctgcgagaattatacaggataggtttttattatacctgtggatgaatttcatatctatatctactctcatggtgattgtttttagtagggcagataggctctgccctgtgttctacattgtttaatccaatccgaaataataggctaacctttgctcttgtgatttcgggaaaatccatcctttaatttttttcccattaaaggttaatcgactgttgaagcgtcctcccattgctcttagttcgtctttaattgctttggtttccccgaataccgctactgctttggctgaatactcaaccattgtacaaccgcatttactttcccctgtctggttggttggtggcgttgtgttggacttactgatatgtatattatcttcgcttcctgctgtgtatgcaaaatcttcaatagtgcgttcacggttatatactggcacttttttaattatccaaccgctatgcctatattctcctaaataataccctgcacccatagagtatttttccctattttcgtaatcctcgttaaactcggctaaataggcggtttcctcgaagtttgatgcgtatttacgcatttcggaaaaaatatcccttttatgtttggaaaagcctaaaatgacggtgcgttgtgtgctacttccgtaatagtcggtttgactatcgctttcgttttgtttcagacgtgccacgattaccgcttgcgcatcttcgggaaatatctcggcaaaacgtttacgccctattaccttaacttcttctactcttatcttctctttttcggcttcgtctgtttccgctttaactatgtctttcgcttcctgaagaagtaacgccacttcaaaaccatccataaattcaggattttcgctgtcgtaataataaccgataccgaatttttcgcttaatggtctgattatgtctgctgtctgaaaaacttttttccgtaggttaatcagcttgtaagtgataccccagttatttttaacgatgtcatagactacatatctgtcatagctataaccctccatttggataacctgattgacttgaacaacctgtatagccttgtcaatttccttgtttgctcctaataaaaatactttgctcataactctaaattttaagggattataaaaaggtcagcattgcgagaataaagaggattatagcacccatacccacgaaaaaggagaggataccccgtataacaggaagaaagagatacaagcccactaaagcccaaataaaccctgttccccacacacagaagcccaaaaccgccaaaacgatttttaaaaccaattttatgctaattggatggtaggctgtcggtcgttgtttcctatttttttctgtacttctcataatttctgactttttttttatgccagtatggagagggtgaggtgtgatcgagtttcaggtgccttactcacgcagtgctttttggcagcatcaagatttttcaaaaaaatacactcgctttcctgtacctgattggggtgcagatacatttctttaagaaaagaggctataattattgcccggataatttcttaaaatctattacaaaagagattttgaatcgaggaagatttttttaaaaacacgtctgatcttgtgcagccaataaacatgaaataaattcgcgcctgatactcgttcactccgaacccctccttttttatggtcataactaaatgaggaagaaattataccgagggaagtacagaaaaaaggaaatttggttgtctgctttgcgtttatcataataaaacgcagaactttcctcacagaaaggaaagctatatacaaaaaaagcctgtaccgatttttacgatacaggctccatttggattgtgatatgtatttttattttgctctggtttttccgtagcatttgctgccgtcaggagataagtagaaatcaaatgtttcttcaacggctgttccacccggagcgattgagtatttgcatctaacaattacggcaagaacatcattcggattcttactgtcatatccgttaagattatccggagtaagattttttagagaatcaatagtattgctcatccgtgcaatatcagcattgtatttatcaattttagcttgatttttttctcttgccagtagatcttcactcatttttttagccagctcaatcttactgatgttaggttgattatttttctgaaattcatcagtaagataggcgatactgtcggcaaccgtaacgttgccggtttcgctaatctcaataattttgaagttgagattttcttttgtgtcgctcccttttaacaggttatcagtaatggttttttcgtaattactcgttgatgagtttgaaccgcaggaaaccataaaaacagcgataagtaaataaaatacgtgtttcatatctaaatgtattaaacgtttattaattcatcgaaatagccggaagttttgagtgtaggttatatactatcagaacttctgttgattttttattatcagtccgggtatattcggttaatgctttcattacccattcccgaaatgcttttgcttcaaaagatgctacacggtagctgacaaatatcagtgcttccagattatacagtaccgtttcgcatgggtgcccgttgctctcaaatttatgtattcgggtaacatcttcttcacggagcaagccggatttgaatatactccgtagattgttaccaatcgtattgacaaatacattaaataagtcggcaatttgatgtttcgttacccacagggtgcaatttacaagttttgcttcaacaatcagttgattttcactattttctttaatatttatatatcctcgttccataatatattattcttcatcctgttgaacattataaccaatacgcttacggggtttattttccagttccttttgtgatgcaagttcggtaagagcttggtaaatatcactaaactgcatatttgtttccaccataaattcctccaatttacgatttaattccgcataacccagtgcatattgtcgtaaagcgacaaaagctctgataatagatatattaacctgaatggccaacgtgctgttaagaacgcttgacagttgggctataccctgttcagtaaatgcaaaaggtaagtattttacgtgttgcccttgtccttgattttctaaggtgccaaaattgcaccttaaaaaatcgtactcttcctttgagagttcaatcataaaatccggaggaaaacggtctatgttccgacgaacagaacgtttcagatttttggtttcaacctgatataattcagccaaatcgtaatccaacataactcgcatacctcggatttcataaatcttgctttgaataatttgtaattccatgataaatatttttagaggtttaatgcagtatccatacctgtaaggtgttctgataatttcaacatatcccgcccaatctttccgttatccattcgtaccaatgtttgggttgtatttatattggtatgtcctaacattcgggatattgtttcaatgggtaccccattcatataggtaatagtagtcgcaaatgtgtttcttgcaaccctgaaagtgagatttttaccaataccgcaaatatcaccgatttctttcaaataatcattcatcttttgattacttgctatcggtaaattttgactgtacttattcaaaattttctgcggaactgaaagcaaagggattataacaggtgtatatgtcatgctccgcataattttgataataggattaccgtctttatctgtttcaaaattttcggttgttagcattgataagtctgaataattcagacctgtaaaacaggaaaagataaatacatcccttacttgttcaagtcttttagtcgaaaactttttgctcaaaatagactgtaactccttttccgaaaggaaggcacgaactacctcttgccttttaatccggtaatggctaaaagggttgttggatatagcctgtttttcacaggctatatttacaatacgacggaataattctattttcttggcggctgtgtttacgttatatttgcgaaacttcatcaggtaattttcaaaacctattatgaaattgacgtcgatttcggacagcaagtaatcaactttcccatatcgttgtttaatgtaatcagcgatatagtttctcaccgcttcatatttcaggtaggtagataaggctttaaccttatatacattcttattatactcgtcgaacagagctattactgttgaatattcattttttttcattactattaaaaattagtgggttaaacagctaattgagtattggctttttccgatttaaaagtgagattgccttcattttcaaaagtattagaccagagagataatttttcttcttctgaaaggctatgccacatgacagatatacgctttaatctttcgggatcatcagacagagtgccgggaagattaaataaagccattttttcatgcaatgaaaggcattcaaaaagtttatctaaattagatttagatttgattcgcctttcttcaagtttttcagcaaaagaagccatatcgttgcttaccttaacatcggtaattcttgcataaatttgggtagtttttatgtttgtatgacctaacatttttgatacactttcaatggaaactccttttgtaagcgtaagagtggcgaaagtgtgtcttgcaagatgaaatgttaaatctttgtcaataccgcaaacagctccgatttctttgagatattcattcactttttgattgcttggaacagggagaactttcttattgggcatcgtccctttatacttctcaataatttgctttggaatgtcgagtaatggaatattgtagcttgtacctgtcttttcacgtttccccattatccacaaattattatcaaatgaaatgcggatattactttcatccaatccttttacgtctatataggaaagtccggtataacagctaaaaataaagatatctcttactcgctccaaacgttcagaagagaattgtttcttcatgatttcgtctatttgttcttgcattaaatagcctctatcgactttcttaaactttattttatagttggcaaaaggatcaatgtgaatccaaccgttatttttggcgaaaagaataatagtgcggaatcgctgtaagaatttagcagtagtattttccttacatttgcagcttgtcattaggtacacttcaaaatttctcaaaaaggagtgatttacctctttcaaagaaatatcagcaacattataatactctttaataaaattagccatgtgcctacgggctacgtcatatttttgaagtgtaccttttgccctgcttataccaaccaatttagcgatatcatcaacatgccgttggaataattcgagtacggtttggtttttaatttcaagaccaagaaagatatttttaacccgatcaggattaacattgttctctttggtgagtaaatcatggtaaacgttgtataagcctgttttaattgtttccagaaaggtatttatctcgacagcttcttttgttctgcccagagccattgacgactttacatcccatgatttaggatgcacatttaatttggtactgaaacggcttatttgtccgtcgattgtaatccggcacatgataggaacactgccatcggatttttgcttgtctcttttcaaaaagaaaagaactttaaatgtacttttcataaactcattttttaatgttacaaaattaaagtaaactatctgttaatgagttttatgcagactgccaattcccgacaacacactgccaattttggacaattcgtacccctttttctttgatttctcgtaccccctgtgtccctttttggtttggggtatgaaatgggacacactaaatgtctttttttggctttattttggctttttcctaagacaacataaataaaaaaagtccctcatattcactgaatatgaaggacttgtctcttttttggcgcctattgacttaggctttccgcggtatggacgggtacgccaccaaactgtgtcttttcgctgttttccagctacttaacccctctttttatctttaggggtacgagttagagccaaaactcttaaactcgttgtacgtcagtcttttaacgaccttaccaaccttattccttttttagcggaacggacgggactcgaacccgcgaccccatgcgtgacaggcatgtattctaaccagctgaactaccgaaccaatgtttttatactgcatctctctcgattgcggtgcaaaggtagataatatttttaattacacaacagtttcatacaaatatttcacattggatcgattatttttttacttttgtcccccatataaactataacagacatgaagaatactccagtagattatcagactgccagacgaataatagatggctacggattaccggatttcgggaaagctacaatccgtgaagttgttgccatatccacacaattggaacaggaaacaaaaaccgagttcatacatatggaaatgggcgttcccggactgaaagcggcgcaagtcggtgtcgatgcggaaataaacgcactaaagagcggcatcgcctccatctatccgaatatcaacggtacgccggaagtaaaagcagaagcatccagattcatcaaggcatttattaatatagatatagcacccgaatgctgtgttccggttaccggttccatgcaagggacattcgcctctttccttaccagcggacaatgcacggaaggaaaagacaccatcctcttcatcgatcccggatttccggttcagaaacaacagatcgtcgtgatgggatataaatacgaatcattcgacgtctatgaatatcgcggagagaaactgcgtgccatcttggaagaacacctttcaaaaggcaatatcgcagccatgatctattcgaacccgaacaaccctgcctggttctgcctgacagacgaagaactgaagatcatcggagagatggcaaacaaatatgatacgatcgtgatcgaagacctcgcctacttcgctatggatttccgcaaagaacttggcaaacctttcgaagctccttatcaggcaagcgttgcgcattatacggataattacatcttacagatatccggttcgaaagcattcagctatgccggacaacgtatcggtgtaactgctatctccaacaaactttaccaccgtgcttatccgggactgacgaagcgttatggcagcggcactttcggtactgtttacatccaccgtgtactgtacgccctgtcatcaggaacgagccattcggcacaggtcgcattggcagccatgttcaaagcagcctccgacggccagttcgattttatctcggaagtaaaagaatacggacgccgtgctgaaagactgaagaagatctttaccgactacggcttcacgatcgtttacgatcatgacctggacgaaccgattgccgacggcttctattttacgatcgcttatcccggaatgaccggcggaaagttgatggaagaactgatctattacggagtaagtgccatctctttaagcacgaccggcagcaaccaggaaggtctgcgcgcctgcacttcattcatcaaaccgcaccaatatgaccttctggaagagcgtttaaagctattcaaagaaaatcataccctataattaacacaaacccggcatttcttttacacttattaactcaaatgccgggtttttcgtttgcttcttaacatcaaaagccatatattgtccctgtctaacacagtaagcaatcttcactatggcatcatataataatatatttaaaataacacataataatgttcttcctgcacaaggaagtatcctcatgtccgaacctttcttgcaagatgcctactttcaacgctctgtcgttttacttgtagaacacaacacagaaggttccatgggatttgtattaaataagaaaaccgatttaatagtaaataccttttttccggaacttgaagagtatccggaaataccaatctacctgggtggccctgtaagtgccaaccgactgttctttattcattctttaggagatttaatcgtgcctgattcggtgaagataaaagaccatctttatttcgatggtgactttgaagccttgaaacgttacatgttgaaaggccattctattgaagggaaagttaaattcttcctgggctattcgggatggacgaaaggacagttaggcagcgagatcaataaaaactcatgggtagtcagtcatgctaccaaagaaaatatcttacttgccgatggagaaagcttctggaaaaactctctcgaacagttgggcagtaactatgaagcatggaccaaatatccgaaagatccttatttgaactgatttattacacagtagatacattcactttttgcatcatcagaacatcagaatatccattttctgtctgaatccaatctgtcataacacccgtaacaatgaacccgcaacgagtaaagagtgctttgctggcttcgttgtctacaggaatatgcacatataactgatgcaacttcaaaaaagaaaatgcatattccatcagaatattcattgcttcagttgccaatccatttccttgataaagaggatccagtaaaataccgataccggcacggcgatgatgcggttcgaaatcatacacgtcgacagtaccgacggccgcacctgttgaacgaagttcgatcatcagacgcaattgcttcaagtcgaatatatcccggtgcgattcccggatatactccttcaatatataacgggaataaggagacatagtgttccccaggctccataagtccggattattttcccaacgatacagaggttccagatcttctggctccaaagcacggagacggattatttcgttttccagttgtgccatattatttccccggtgatattaattgtccgctttccttacaataaatatgataagtaactttcttactgaccatcgaatccattaacaaaagcatctgttcaaaacgggcatccggatagcaaatggcataatcagtaaattccttcatctgattacgacggcaaatggcatccatgacacgttcttcatccagatcccaaagatttatatgttctagttcgggcatacgtttcacacaagcagccttgataacctcaaaattgtcctcacgacaaagtaccagtaaacgtttatgcttactcctggacttttgcttgactcccaacagacgtgagcaagcagccaatgaagcacgcaataaaatggccagttttataaaaaaacccatcagccaaccggaatgaggataatatttccggaaaaagatcagcatggcaccataaaaggccttcacatatttcatatcgccatgcttcgtactttctcctttgtaatgaaggatacgttccggaatataataattcttataaccacctaataccatccggtacgacagatcgatatcttcaccatacataaagaaagcttcgtctaacaatccgaccttgtctaacgcatcgtgtcgaagcagcataaacgcaccggccagcacgtctaccttatgttgtttctccttgtccagataagccaaactatatcttgagaatatacgcgatttaggaaacaacttcgataatccgaatattttacagaacgaaacccagggagaagggaaactacgcttactctcaggcaggaatgcaccatgcccatccaacatcttcacccctattccgcctgctttcggatgttcatccataaagaaacaaagagtccggagactctcctcacctatcacagtatcgggattaagcaataacacgtactctccattgcattgacggattgcctggttattagccttggcaaatcccggattatccttgttctctataaaagtcacttccgggaacctggggcgcagataatcgacagaaccatccgtagagttgttatccacgacaaatacttccgcatcaaaaccagcaacagcagcacggaccgagtataggcattgctccaaaaaatactttacgttatagtttacaactataatggatatcttggtttcgtacataagaatcagattatatttttatcgaatcattaaaactggtccggttcacgatagaacgacccaacgttatttcgtctgcatattctatctcgtcaccaatggaaacgccacgggcaatgaccgtaatctttacatcataagccgacagtttacgatagatgaaaaagttggtagtatctccttccattgtagtactgagggcaagtacgatttcctttacttcatcattggctacccgttgcaccaaactgtctatttgcagatcacccggtccaataccgtccataggagaaataataccacccaggacatgataaacgccccggaactgtccggtgttttcaattgccatcacttctttgatattttcaactacacagacagtcgaatgatcccggtgaggatcggcacagatggaacacatttcgtcatcacaaatattgtgacacactgtacaatactttacatctctccgcaaagccagtaaggcggacgcaaagttttccgtatagccttcatcccggcgaagcatatataaagctaaccgcaaagccgtcttccttcccactccgggaagcgaagccaactcgtttactgcattttccaataaagcagatggatatttttgagtcattgattacctttctttgaccacaaagataggtaatttcaatcatatgaaattcgatcaaccgatttttactggaaatcgcctttggggacactcaaattcgaacttatattatttagcatagaaagtcttgccattaaatagcaaactgtcgattcagctccctgattcaaattgatattatcttcttccaacccatcataacaacctcctgtggccggattataaagtatctgatgaagatgattattacctaaaaaccagttgaaagcctgtgtctgtttcaataaataatcgttatccttaaatacattataaaatgtaaccaatgtcataacagtacttgccacgtcaatcggttgttccccataaatcagtccttttttctttttgtgcagccacccccggttggaaaccactttgatgcgatcttctacaaagatgttcttcagtagaaaatcgaatgactctttagctatcgttttatatttttcatttccggtagcctggtaagcgaaaagtagtgcttccggcaacacacagttatcatatgtcaagtaggattcaaaccacaaccactcaccatctgtactttgtttataaaatccgaccaatttatcagccagcaaattgattaatgaggcaatctccgggcaagaataccgtcggttataatagcaaagtcctttcaatgcaaaagcaatactacgcggagactgaaaaccagaaagcacccgaagtgatcttctgaaaatctggattgcttcggcagtccattgatcaggatatttatcgccatgaaaaataaaataccccaaagcacaaattgctctcccattactatcctccaaacccacttcctgattttgctttgtaaaagccagttccttatccacataattaaagaaggaaccatccggttgcaaacaatactttatgaaattcagatagctcctgatatacttttcgcaggagacatcccttatttctacatagacctgacaaagtgccattaatgcccgggcattatcatccaacgtataaccggttttaatatccggacgattgcctttagagaactggatcatagcaaagttccggctcattcttttaatatgtcttacatttatcggaggtaacgaataaagcagttcgtcattatctttcaatacactctttatcaataagatataggctattgccacattctcccaagcggtagcagcagttttctgcaaaccggttattctcattttagaccggagactttcattcgacagtagccggttggttgccgcagccaactggatggaatttttaaagtcgaagatgatacctgaattatccttcaacaactctaatgcatgaggaatcggagtggctataataggacatccgcaacttaaggcataaacaaatgtaccgcttaccgcctgattaggatcacaggaggtaaacagatatacatctgtcagctgtagatactctagcaaagtggataaatccagatagaaatttacaaaacggacatggtcagtcatacccagctccataactttggctttcagcatctcccgatatttctctccttctgctttaaacacagtcgggtgtgtcttcccgataatgacaaacaagactgtcggattttcttttacaatggcgggtaaggcctctaaagttgtttcaatgctttttccggcactcagtaagccgaaggttgaaagtatccttcttcctgtgactcgatatttatctttcagcagtctcttatcctgatgagcaacgaggtgtgttccatgtggtatcacttctattttatcctcttcaatctgataatcctccagcaaaatacgtttggaaacctgcgtcatcactataattgcagcacaagcatttgtcagttccagtagatattttttcaaggaagcgaccggattagacaatacagtatgaaagacgattattacaggctttgttattgatttcacaaactgcaggaaatcatcttcatgttcactatacaggccaaattcatgttgtatcaggacaagatctataactgcatcctgattgatctgtgtgccaatgactgtgtagtcattggcgtctgaagtatttaacctatattttaccgtatcagaataaacatgtttttccgaatccgattctaatgcacaaactttaatagaataagtatttccgaatttgtacagaattgcccggatcaaatcgcctgaaaatgtagcaatgccacattctctgggaggaaaagttgttatacataatatattattcattttttatgggatattaattcattaactaactcttgaagtactaccgatatacaggctatgcatttgtctgccgccccataataaatatacagtctgccaccaaacaaagtagtaccggtagggaaacaaactctgtttactatgcccagcaactcataatccgtatcgggagtaaacaaaggataaggcaatcgcgccagttctatagaagggtcattcagatccaataaagcggcacaggcagaatagacatacccttccggagtatcatatacgctatgataaataagcaaccatccttcaggtgtttcaatgggaggacaaccggcaccgatataacttgcctcatgacggtactgaggtttcaacagaatgtgatcgaaaaaatcaataaaataatcagtccaaaactttgtggtcaagtcttccagtttcccgatactgaccaattgtatatccggtttgatccgatgcataaagtagaatttcccattaatcttacgagggaaaaacactacattcttatctgtgagatagatcttttttccaagattagtatttgattcccgcttattataagaacggaaatatttaccgatctgatgtccatgcgatgtcatcaatcttttaaactgacggaatgtaaactgtgatgtaattactccttttttttcaaaatgaactaaatcggaagatacggctaacgctcctacggcactgttgccatcataagccgtataagtcagataataggtatcatcgatctttacaatccgtgggtcttctactccctgagcttcataaacatactcaggccggattaaagggtcttcatttcgttgaacaactttaagggctccttccaacctacaatagccgatagttgaatagttaccctctttcactgcacggtaaaacatatgtacagtatctccttcggctatgacagccggattcattacgctttcgttttcaaaacttaaatctgtactttcaagaataatgccttccctttgtatgtttaccattatgtcttagttattagattaaagcctttgtcttgcttactctttttttcgcgctgatagtcagtctgagcttttattttatcggctccagacttttccttcttcttttctttcttgttttctttacctttcataatacattgtttgacggagaatttatactagagaattagtaaaacgtgaagtgatggatatatggttaaatattttattttctgcaatttactaataatatctcctataaaatcatatggacgaaagaattgttctttaataactataagagtctataattcacaatgtacatttgtacggttctgacaaaccttttatttatcaatattgtttcataattactgcacaaagttgtgacagtggaaataattaaacaataaaatagaatgaatagtagaaaaatcttcacattactggctttaatgattggctttatggctttagcttcatgcaaagggcaggccaaaaccaacgaaactgcaagtagcaccgagacgacaggaaaagatgctactgctcctatacatatcaacaaggcagactttctgaaaaaagtatataatttcgaagcgagtccgaacgaatggaaatatctgggtaacaagccagccattattgacttctatgcagactggtgtggcccctgcaaaatgatcgcaccttctctggaccaactggccaaggaatatgccggacaaatcgatatttacaaagtggatgtagacaaagagaccgaactggcaaccgctttcggcattcagggaataccggctctgttatacattccgatggaaggaacgcctcagatgcttcagggcgcacagcctaaagaggttctgaaagaaaaaatagaaatgatcttactgaagaaatagaaagaaacatatttcaaacagcataaacaattaataagccggaaaagcaatagttgatattgacttctccggcttttctctttatttatcaaatatttaggtataatcattctaaattcatacgaaagcgatctcctttaaaaacgaataactaagcaaatgcagcattattattgatgttttttgatccaaacagccaaattacgaccattgacggaaaactcaccatttccctctttgtctatctgtacttcatcggcaacgcttccagtcaattcataccatttttctcctgcatgctctttgcctaaattcatcgtcttactgcctttttcatcatttgaaatcagaaaaaccaaacccgatcccggatgctcagtatccccactccttacgaaaccaacagtggaaggatgatcgaaataatctgtttgttctccgtaagcatatttccgacgggcatccaacaaaagatcaatgatctgcgtgtggggcgacttctctccatttacaccataataatcaccataaaaaagacaaggatagccgtcttttatgagtaaaaccaagccataggccaacggtttgaaccaatcttcgatctgtgactccagagaactacccagttgcgagtcatgattatcgacaaaggtgacagccagttccggatgcagttctaccaaggtatttttcagaatgttctgcaagtcatattcttttccttcctgcgaagcctggaaaagattataatgaagcggcacatcgaacagactgattttattcccgactgcttccagatagttgtccaacgtttccagatcaccgttccaatattcacctacagcaaaaaagtcttctcccctttcggttctcacagcttctaagaattgtttgacaaactggtccttcatatgtttgatagcatccagacgcattccgtcaaggttcaattcgttagaaacccattttccccaacggttcaattctgttattacttcgggatgattaaggtcgatatcatttccgagaagaaaatcgtagttcccattttcggaatccactccttcgctccagttcttattttcacctaagatctggaaaataccactccttcttgatttgtcatcaaaacccataccggaaaaatgataccagtgccatttaaaatcggaatacttctcaccccggccgtggaaattatagccggtccaaccttgtacttcaaactcatcgctgacaggtttcgtacggtcggttggatcgacttctacaaccataaacttttcagtataatcgcctccggccttatggttcagtaccacatcgagataaaccgaaatatgatatttatgcagttcatcgatcattgccttcagttcctccttcgtcccatactttgtcctgacggtacatttctggtcaaactcacccaaatcatacaaatcgtacgtggcataaccttcatcttgttgctcgtccgctttatatgcaggcggaatccagattgccgtgacaccgatttcatgtaaatgagatgcatcttctttcaactgtttccacaaatttccgttattcgggagattccactcgaaatattgcatcattacgccgttttccatatactaactcttttatttatcaataataaaacaacggccataaggagaaagttcctgtacctcctggaatttataagctaatactctaccatcaccctcaacatcgcaatatgagacctctcatttccagtccgtataaaatggaatgcaggttgcacgctaaaatgattcgacaccgtataattccacgttatttccaaagccttctcccttatatcggagaaagaagcttgcgaaaagactacccccagagtatcttcccccgaagccgaaaatagtcctttgaaaatacctcctgcagccatataccgccgacagtcattacgatcggatggagcgaaagaatactgccccaacactcccgccgaatagcggcccgaatgccaacactcctgctccaccgaaagccagcaggcataattcacctttcgatgtttctccgacgtcgtttccgccgatgcctgctccggtgccaaactgtcgtctgccgcatcacagcaacgattgccgccatgtacaacaatacccaaattataagaaccatgataactgctgtttgtagtataatccatttctgcaatatccattaagccatcccgctgcggtgaaacggcaaataccgaacttccctgcttaaaaggcagataagcctgcccgttataaagactgttctttatcccgatcatctcgtttatccggtattccagatgcaggcaaacggcagacaaaggatagtttgccaatacataattagccgatagcgtcggataaattccacaagagctgttcgtaaacagggaggtgtagggagttgtgaaataatcctcgttcacattccgcaatcccccgaacaaaagtacttttcctatttgctgggaatatcccaggagaaaggggctgaaaggcagattgtcctcttctatatttgaaaaaacttgcctgtctccagcgatccgttcgcgggaagtcttatagacggagatcgtctggacctccaacttcccgttactccacagccccagccgttcggtcggaatcgcaacgcggagagaaagaagattcacccaattcaaccgattgcctaaatccgattgcagttcggtagtgtactgaacggatgcctccagttttgcctgggcaaaaaccactttctcctcacccatctgcaacactattatagccagcgtgtaaaccgttttacgtaccattgttttacaaattgagtcaacatacaatatccaagtaaagtagcaatcaaccaggggaaataactcagcggcagcggtacaagcccgatagatgcccctatccctgtaaacggcaggataatgccgatcgccatgatcgcaaaagtggtgagcaataccggccatgaagcgcggctctgtatgaacggtattttccgtgtacggatcatatgcacgatcaatgtctgcgaaagcagcccttccacgaaccagccgctttggaacaaagcctgatgttccggcgaagtacacccgaatacataccacatcaacagataagtcgtaatatcgaatatcgaactgatcggcccgatgcagatcatgaaacggctcagatcggaagcatcccacttacgcggcttcagcaggtattcgcggtcgaccttgtcaaacggtatcgtcgtctgcgaaacatcatacaacaggttctgcaccagcaaatgaatcggaagcatcggcaggaaaggcagaaaagcactcgccgctaacacactgaacatattaccgaaattcgaactcgccgtcatcttgatatacttcatgatattgccgaatatcttacgcccttcgagaacaccctgctccagcaccatcaaatccttttccagcagaatgatatcggcactctccttggcaatatcaaccgccgtatctaccgaaattccgatatccgactgacgcaaggccgacgcatcgttaatcccgtcccccaggaaaccaaccgtattcccaccctgttgcagtaacgtgataatacgcattttctgcatcggagtcagtttcgaataaaccgtcgtatattgcagctccttcaccagttcctcgtctgtcatcttctcgatctccggtccctgcaacgtatgcgtaatatccacaccgacctggcggcagaccgctttcaccacagcctcgttatcgcctgacaataccttcacctctacaccatgctcatgtaactgtcggatcgctccggcagccgaggatttgggaggatcgaggaaagccagataacctatcagcaccatatccatttcatcctccaccgagaaatccagttccttttctatccagctcttctgggcaacagccagcacacgcataccgtcacggttcatccgcccgcttattgccaaagcaatctgcttcagctcgtccgtcatcgggcatacttcaccgttatattccacatacgaacagatctgcatcatctcctcgatcgcccctttggtgatgatctgtcgcttaccgtcgttatcttccacgatcaccgacatacggcggcgggtaaagtcgaacggaatctcgtccactttcctgtatttatcacccagatgttcgaaatccagttccttcgcatgcgaaaggatcgccttgtccatcaggttcttcaacccggtctggaaataactgttgaaataggcatgccgcaacacacgcagatcgtcatccccatgcacattgagatatttttccaatacgatcttatcacgcgtcaacgtccccgtcttatccgtacaaagaatattcatcgctccgaaactctgtatcgcattcagattcttcacgatcgtcttgcggcgcgacatactgacagctcctttcgccaaattagaggtaacgatcatcggtaacatctccggcgtaagaccgacagcaaccgacaccgcaaacagaaaagcatcgaaccagtcccctttgctcaacccgttaatcaggaacacaaacggaaccatcaccagcataaaccgtatcagcaacaaactcaccttattgattccccggtcaaaactcgtctgcgcccgcacccccgtcaggcttttggcaatcgtccccagataggtagaacgcccggtagcaaacaccacgcctattgctgatccgctcaccacattcgaccccatgaagcagatatcatccaactcgaccacactgcccgtccggtgcgtcctcttccccagttccgctcttttctctatggcatccgactcgcccgtcaacgacgactggctgacaaacaaatccttagattccacgatacggatatcggcaggcaccatatcaccggcagccaggtaaacgatatctcccggcacaagttctgcaatattcacttcctgcccgtcttttgcacccaggcggtagacggtagctgtatttttcaccatccgtttcaaggcatccgaagccctacccgatttccattcctgcacgaaacgaagtaccgcactcagcatcaccatcgccgtaataacgataacggtcacccattccctgtcttccggcgcagccatcaggacatctatcaccagcgagacaaccgccaatgccatcaatataccgataaaaggattgataaaggttttaataaacatgatcagccaacggtcgcgcttttcgcgtacgatttcgttaggcccatgaaaacgtaaacgatctgtaacttctccttccgtcagtcccatacgcgaagtgtcgaaataactgaatacagatttcagtggttgggtagctgccagaaatacccgttcgctgttgaaagagattgcgttgttgttctttcttttctttcttctgatccacatgataattctcttttatgaagccccctgctcccaaagcaggaggtctccggtttggtattcgttttatgtctctctttttgacaacgcaaaagtagagacacccggccagacaagccgttagagaactattagaagggtattagagaaccattagaattttacagtttacttctgcttctaaatattgatacctctatcctcatcccaacatctcaaatatttactacctttgccgccaattgtaaatcataaaacgaaacgtcatgagtaaatatccatttatgctgattttgtgcctatttattgcacaatcggcttttgcacaatcatattccaaatactttcgcctggaaaaccaagataccgtcaactttacttttactgtgaagaaaccagatattaaggcaatagactgttatcctcaacagattatccaaatatcgaaaaacggagaaaattacgaaatatcactcacgactatcaacccctacctggatggaagcaaactggctaaaatgaaagaagccaagtatgacaaatcacgggaatacgacagagagatcgctagatttttgcaatctactccgttgatagatgcacaaaacaaacacgttaaacaaattgccgatacactgttcaaagatgaaacgcaaacctttgtcataatagagaaagcccttaaatttgtctatacctatctgtcaccttccgactccattgccaaacagatcgatgcagggatttgcagaaccgtagatgtcaatacagttatccagacaagaaaaggtacttgtagcgaatatactaatctatttaccgcattgatgcgctatatgaatataccgacccgttttgctgtaggatattggaatgtccctgaatggaataccgaaagtacccatgcctggcctgaatgctacatagaaggtgcaggttggtgttctgtcgacccaacatttccatcgtatatctgtccgcattttgcagaaatcaggatgcgttacggaatagattatgaagactgcgacatcagaaccctaaattatgacatcgagccgatcgagtttacaaagaaatgaccctatgacgacagaagataaaataaaatattttgaaaatagggaagattggagaaagtggttggcagacaactttgaaaccaaagacgaaatttggtttgtcttcccttgcaagtcgtcagacaaaaaaagtattacatacaacgacgctgttgaagaagccctttgtttcgagtggatcgacagtacgataaaaacacttgacaaaaaacataaaattcagcgtttcacgcctagaaaccctaaaagcacatactcgcaagccaacaaagaaagacttaaatggttattggaaaataaaatgatacaccccaaatttgaagacaaaatacgaaatgttctgtctgaccctttcattttccctaacgatataattgacaaactgaaagaagataagatagtatggaaaaactatcaacaattttccgacccatataaacgtatccgaatcgcatacattgaagcagcaagaaaacgaccagaagaatttgaaaaacgattaaacaactttatcaataaaacgagagaaaataaaataataaccggattcggcggaatcggaaaatactattaaccccaataaaattggagcatacaacgaaagctcacaatacacattgaaataatcacctatatatcagcttttttcatatatttgtatcctatactattatacaaatcactttcggagatactataacacttaaaaacagataagatgaaaaaagtaatttttgcaggcgggatatataacatattctttgtgctattccacatcggattttggaaaatatgggactggaacacagagttggaaaagctgtcattcaccaataaatggattatgcctattctaaatgttcaaataatctactactttatctttactgcggtaatttgctttgcgtttcataaagaactatttacaacaaatcttggaaaatgcttcttgatgagtactgctggattctggtttattcgagcaattcaacaatttgtattttgggaactaggtgcagtctctacaattatcggggtattattttttttattgggatcagttttgtttcttattccggcaatacgtaaacaaacgacaggtactattgaataacgtaaacccgcacccgaatccaagtattgttatattcatagtcgaatgatttaacgatctattattacttttctatagtctccatcgcctttcttctgaaagccatttctcagtaatgcctttatagaaatgatattttcatccatcagaggttttaatacaagttctttcttatttatcatggatttattcgttatagtattttatttgatgacatccatttgtccatttttattttatacacaaaacaaaaaccattctaccctaaagtttgtaggtctaaaaaataatataatacaatgcaggaatccgaagaaacctgcaccatataaataaaaatcaggaatcagccttacgcctcttcacttcttccacgagctttgtaaaggatttttcctttttacgtttttcatgctcggaggcggagaaatgccaggcttcacgctttagtctcagatagctttcatacactttggtatctagcaaaccttctgcaactgcttccagaacagcacagccgggttcattggtatgtgtacaatccttgaagcggcatgattctgcataactggaaatttccagcatttcagcaagtgaatcgggattatctacagctaatccaaattcacgaatacccggagtgtcgattaaaacacctgagccgtccatcaagaccatttcccgccgggtggaagtatgccgtccttttcctgtggactggcttatatccgacgtcagcagcaccgacctttcacaaagcgcattaacaagagaactcttccccacacccgacgaaccgacaaacaccaccgtttcgccttccgatatggattctcttaaccgggaaaccgtttcagggtgatggatacttgtgaagaacaccggcatcctacgggtaagatgcctgattgcttcctctgtctcctgtttatcaaaagacaaatcagtcttattgagtatcaatacgggatggatattttcttccaatatctgaaccatgaaacgttccaccctgcgcatattgaaattatcatcgagactctgcacgataaacgccttatcaacatacgaagctattacctgttttccggctaccgttccatttctcttgcggtataaagtccgttcacggggcagcatatcgacgataatccctttactatcgtcgaaaggttgaaacagaatccaatcgcccgtacaaggcagttcaaagtcagatcttccatacatcatatttcccgtcaactcacattggaacaatccattttcggaaataacttcataacaggtgcgatgcacgacggctatccgtccgtgagataacgtattatatgccgattcttgtttcagttggttcaacctgtcattccaaccatacatatccaaacagatcatagcgttatctttttagcgatataaaacacatagccgtagaatcctttatacttacggtataattcctcttcgtgatgtgacatcgcgacaagttcttcggctgttttatttcccggatatttggctagaaacttttcccgtgctttaaccaaaggcgcaaaataatgctctgtccagcaagtctcaggcaaaataaaggaagcgacaggaagatacccggccttttgtatcagggctacctgattgggaatagtatctatttccggataagcctccatccaaaaatcatggatctctgccggacgttcttcagtaaaccatgtgctttcggaaacgacgatatatcctcctgttttcagatatttacgccattcgttcagtccgcgttcaaagccgatattataaatagctccttccgaccagatcaggtctaattcaccttctccgaaaggaaggttatccatcgaaccgacgattccttccactctatcctgaagattcagtttcctggcattgtcgttgaaccggtcgatgaatcccggaaaaaagtcgagacccgtaatatgtcccggcgcatgctgcgccaatgtcattgtctgtccacccgtaccgcaacccaaatcggcgataagggaccggtcggtcaggttgtctataaagctcaatgctttaagggtcacttcgggacttccgggtccctgacgttctgtgtttaaaaaatattcgcagattaaattaatatcgaattcgtgaattgttttattttcgttactcattttcttttatgtatatagcatactcgtgaaagcataacaatgctatcatcattgtacactgattaaaattgaactaatacaatagaaattacgcccgagcagaattacccgggaataaacgaaaggacaacctgtacaaggaatacagattgtttactacaccaaatccgatttaaatagtttgtttaacatgcggcaaaggtacataatattttgtattatgctaattatatatgcggaaactccaccacaaacacagtcccctcgcccggataagaatgaacgtagatatttcctttgtggaggaaaacgatcttttgaaccaacgccatccctattccattgccaacagcatagttacggttactgccacggtgaaaagcggtaaagagatgttccatgtcctctgcggggattccaatgcctgaatcggaaaagcggaggatggatttttcttcatagaaagatatctgtactgaggaagttttgtcgtcggagaatttacagttgttctccatcagatttacaaaggctgttttcaataaataagcattcccggaaacggtgatcatggcatcgtcgtcggtctcttcttcaaaaagcagattgaccttatactccttattggctttcagaaccaattcgcgggcatcgagtaacagctcgtccaggcgtacctcttccatactgatctgctccggctgataactggcacgggccagattgagcaagccctcagacaatttcaccaccttatccgcatccgtcaaagcttcttccaccgctttccgataggcttcaccggaacgctccttgagaagcgtaacctccaggccaccgatcaaggcagccataggcgtacgaagttcatgggagacattactgacaaacattttctgcgcatcgaacgactgctccaaccggtcgagcgtatggttgaaggtcacagccaactctcccaactcgtctttctcgtccgctaccggaactctttcgtccagattggatgccgttatcttctccaccttcctgacgatattcgaaacaggcgacaaagcacttcgcgacagaaaataccccacaacagccagtaccgccagcccgataccccataatatcagcaggatattccgtaaagcatcgagtttcgcatagccataaccgtcaaatgcagcagccgtgattacatagtctttcccctcaaacggatacaaaagtccgaccacctgataatctccttcaaagaattcgatagatttcttttcgacaatacgccggatcatttccggggtttctttcacccggtctatctctttggcatcatgataaagcaggttgaacgacgggtcatagaccgccacctccacctcatcgataaactcccggttattcatgtaaatggattgcatggtagcggcatcgaccttatgttgcaggaacagattggctttcgtaatcccctcctttttcaggtcacgataaaaaacacttttccggttactttccgacaagaaccagatcattcccatcaggaataggaagacagtagctgtgactgccgtataacggatcgtcagtttagtcctgattttcatcggtacgcagtataaaacccatgcctggcttagtatggatcagtttaacagaaaaatcacggtcgactttctttcggagataattgatatagacatcaataaaattagtccccgtatcgaaatgagtgttccaaaccttatcggctatctccgcacgcgacaggacacgctccggattctccatcatataagccagcaaattgaactctttaggtgtcagttttatctcacgtccatcacggaagacagacttgccggacagatcgatacgaaggtcggcatagtttaactcctggggttgaacagtctgcgaagcgacaacttttcttttcagcaacaccctgatacgggcatccagttcgcggaaatcgaaaggtttgaccatataatcgtccgctccggcatcgaagccgtccagcttgtcatcggttgtgcccaaagcagtaagcatcagaacagggatatccggattcagttgccgcacctctttcgtcaactcaaaaccattcatcttcggcaggataatatcggagatcaccagatcgaaccccgaagcccgaaaaagacgcaaccccatctccccgtcaaaagctaccgacacctgatagccggaatcttccagaccggccttcaggagctccgctacacgctgttcatcttctactaccagtattcttgtcatacgatcttttttgtttttgggattactgaatccgttataaggtttacaaagataataatttcctatattcacagtatatccctatatttgtcccactatatattttaaacaagggaaatggtcaagaggattgttatcatcggagcaacgtcgggtatcggttatgaagttgcaaaaatataccgtcagctaggttggcgtatcggagtggcaggacgccgtatcgaacggctcgaagcattcaaagaacaggctcctgaacagatagagatacaacaacttgatgttaccgaggtcgatgcagtagaaaaacttcatcaactgatcgacaagttgggaggcatggatctattcctgctcagtacaggcatcggtagccagaataggatattaaatccggacatagaactggcaacggtgaataccaatgctatcggttttacccgcatggtaacagccgcctaccattattttcaggaacaaggggcaggacatctggctgtcatcagttccatagccggaacaaaaggcttgggagccgctcctgcctattcggccaccaaaagatttcagaatacctacatcgacgctctggcccaattggccagaatggagaaactgcctatacattttaccgatatccgtcccggcttcgtaaaaacagacctattgaaaaatgataaatatcctcttttgatgcgtcctgaacgagttgcccaaaagatcgtgagggcactgagcagaaaaaaacgcactgtcatcatcgactggcgttatgtaactcttgtgttcttctggaaactgatcccctcctacgtctgggaacgattgtcaatccataattgaatttgtatatcttttccgtaatctctacctttgtgcccggttatcaaaatgcacaaataaaagaaaatgggattattcataaagaaacctctgggaaccctacaggcagaagcaaatgaatcgggaagtaaaacattaaaacgggtattggggccgtggagcctggtagcactaggcgtcggcgttattatcggagcgggattattctcgatcacaggaactgttgcagccggatataccggaccggccatcaccttatcgtttgccattgctgccctgggttgctgctttgccggactgtgttatgctgagtttgcttcgatgatcccggtggccggaagtgcctacacctactcgtatgcgactatgggcgaactgatcgcctggattatcggttgggatctcgttctcgaatacaccgtggcggcaacgaccgtcagtatcagttggagccgctacctcgtagttttcctggaagggttaggcattcatttaccacaaacacttactgcctgtccctgggatggtggcatagtcaatatccctgctttcctgatcgttgtcctgatgagtatcttcctgatccgcggaacggaaggtagttcgatctttaacgggatcattgtattcctgaaggtttccgtggtactggttttcgttgtactgggttggaaatatatcaatacggacaattatataccttatatccctgccaatacgggaacgctcggtgagttcggtttctcgggagtacttcgcggagcggccatcgtctttttcgctttcctcggattcgatgcagtatctaccgcagcacaggaagctaaaaacccgaaacgcgacatgccgatcggtattctcgtctctctattggtgtgtaccgtcttgtatatgctgttcgcccatgtgatgacaggggtggcacattatacccagtttggcggacaagaagggattgctcccgtagccgttgctatttcacatatgggaaatgcagatacggcaggtatcatccagccggattatccctggctgaataaagcgatcgttctggccattctgttcggttactgttcggttatcatggtgaccctgcttggacaaagccgcgtattccttagtatgagtcgtgacggacttttacctcctttcttctcccatatcaacgaaaagttccgtacgccggcacgaagtaatctgctttttatgctgttggtaggactgttggcagcttttgttccggcccgtgtagcaggtgaaatgaccagtatcggaactttatttgcattcacactggtatgtgccggagtattggtggtaagaaagacaatgccggacgttcagcgagctttcaaaacgccgtttgttccgctcattcctattctgggaatcgtgacctgcctttgtatgatgctctttctcccggccgatacctggatacgtttaatcttatggatgttgctcggactggatatctatgcttgctatggcattaaacacagcaaactggaatatatgcagcagcatcgtaaagggcagctttcactcaacatgataggtatcaccctctccgtcctctgtgttatcaccggactatggcatcagcagacagtgggatgggatgaaagcaagattctactgatcatttcgttcgtattcgcattcacacatttgccattttatatggtacgggtttggagaaatacaacacagagttgaatgcttaaattattgacagatttgaatgtagtgcgttggtaggggcggttcgcgaaccgcccttacaggcgccgtcacaatggaacaggcaggttcggccgtaggggcggggtctgcccgcccttcttcaccggttgttatattattgtcgcaaagggtgggcaaaccccacccctacaaaacctgtcatttggcttcacctttttctaaagatgaacctccgggcaatcatccctatttatttaaatccttcagcaaaatcttccccggtttgaattttgcacttaagcggggacggatcaaacaagcctctcccgtacgcgggttacggccttcacgggctgattgctcccaaagatagaaggttccaaacccttgcaacatcaaagttttatcttctttcaacgcatccgccatagaagcctcgaaagcgtttataaaacgcctggcttccacttgggtgatagacattcgtttagatactcgttttgttaattctgttttattcatactgttttctttttatttatttgttcatttcatctgtattccccatccggtttgctcccaggctttgttcaatacaggatagtcatgctgtggtatataaacggtcaggccgctatggctatgtatcggcaaactgacaaagaaaggtgtcgcacacttataacgaataacatccgacaacacctccgttgcatgttccgcaactacacgtccgtccgcttttccggttgcataggtaatcagacttgccagatcaaaaaacagccgatcgtccgagcggtcgaaacattgaatgtttttcaactcttcactaccgatctcatcaggcaaaagacgatatacctctcctactgcccgtgccagctcctccatttcatccaaccgtatcacactgaccgtggcactccggtaaggagtttcctgttcattgcaatacgtataataggcagcagccacctctgtcagtgccgcttcaggttgtgcaaacaaagcctgaagcatatcttcgtacaccggagtgaaccccggactcagtatttcagtcgatgatgcaagcagataaccggccttgtcccgtaactcgtaagccacctccgcactagccatcaggcacgcttccaaaacgataaagtcaaactgtccgtcaggaatagccgctgcaaaatccgctatctccatctcgcgtccggcatcgtcaatgatagaacgaagcccttctcctgacacccctcttccagcaggtcgataagcagcacgtggatcgacataacttccagcaggcagccagcccgttccatgactgaaaagcaacaacccgtaagaaggagccggaaaaccactcgttgcatccctcaaaacatccgaaaaggcctgcggatcagccgaattggcatccggatattcttttacgacctcggtataggaatgactaccattgcaaatcaccttcatcagtgaaggagttcctttctccccccgtgtatcctgatagatcagcaggttatcctgcatattatgccagcccgaaacaagcgcgtccaccttctcccatacttcccccgacagactgttatcgcccgccagataaaccaggacagtacgccgggcagacggcacagttttcacactgtgctcttcgctacaggcaagcagcaaggaactgcaaaataagattccaatcaaatggtttattttcatttgtttcaattattatcagatgtgaatgtaggggcggtgtcagccctatcgactaacgttagtcggaggtgtcgacacgcacgtgtcgaagggatcgacaaacacaggtcggcatcatcgactaacgcttgtcgacacacccgacgagaattactcgattacggggcgatcatcctcgccgccgggatcgcctacgaacaggggcttcttgtattcaagcgtacgggcctcttttagttgatggctacttgtactatactgtgttacaatacgtaacgtatagctaccatccgccagggcaggtacacgggcgattatcttgccgggatcgttttgagtcagacggcgcgttacttttaccgcctcgccgctttccggcacgaagaaaataccgactacggactcatcgccggcgatcttgatcagatctcctgaaatcatgatatcttcgttcggagtgatcgttccgtcgatcaggccggtcagcgtatccgtaacagtgccgatacgagccacgctttctttagctcccagcttgatagtctttactttctttaacccttcgcgcatcgttttggtaaatattacgtcgaacgtcagccggtggatagccggatcgaacggagcatctacattataaaacgggcctgtgatacgcgggatgaactgacaaatgtcggtaatcacgctatcgccgttcaacaaggcttccattataatatcattgctttgggtggttaccgaaaggatagtcggcagcttcaattcggaaccggtacgtttgatctccttggcaatatcctctttgcgcaacgtcctgggcccgcttttcacttcggccacacagtcctccgtattgtcttttgtcaagggattgtcacgcagggtgaattcccaataatggtctttttcgtaatcagccatttcattcgttgtttaattgtttataccaaatgatttatccggtttatccccggatatttttcaaattctttacgtaatatgtatttctggaaaccgttgcagaaatatccgtagagatatatctgcgaacaacggcccagaatctttctttttatattcaaggtgcagaaatgctgcattatacccaaatacgaattgatggatgcacgcatcatccgaagtttgtcgggaggcgcccgattatcatccaggttactctcccaataatacatttcggcagcaaacttccacttggcacggttctggatatagatacgacccggcttaaccatcgcacccagaaactccaccccgtttgtataatgctgcaatgctatctttttaggatgtaacgtcactcccaacgtattccacagataattacggatttcagggatcagggatttcaatacttccttgtcctcatgaaccaggaagaagtcgtcgacataccgtccgtaatgcttaattcccaactcccgtttcacataattatcgaaaggtgtgagataaatattactaaacagttgcgacgtcaggttaccgataggcaacccgcatccttgcggcgaatgaaacaggcttttggaaggaggaagtccttcccagtcagccacatccccccgcctgacacagttcagcgtaggatcattaaataccacaagcggcaaaagatattttaccaactcgtattcttccgaatcctcccaatgaataccgtccggcatttccagatatccgtatctgtctaacgttttcaggatggaatcatataatatctgacggtttatattcatgaaatatccctgaaggtcgagcttcagcacataacaatccttcgtatagttgtgcgaacaactgcggatatgcttatcgagacgcttaatcccgaataatgtacctttgtttttccggcaggaataacaatcatcaataaaaacccgttcgaatatcggcgaaatgtaattgaataacagatgatgaacgatgcggtcgcgaaaatcggcggcaaacacttcccgctttacgggatatgtcaccatgaaacagatacttcgccctacctgatacctgcggtcggccacttcgcgataaagcgcgacgaggttttcctccaggttcatttcaaaccgaagctgattcaccgagtttcgtttcccgcgtcgggcatcgaaataggctttgaatatgtcttcaatcaaatccatacattagttcaacttataaataaaaggcgactagtaaatgcttggacacaacgcaccgagaagccgttggcacggttgttcgtgttcgtattcaacttacctgcgctattgaagttcacgttgctggcgttgacgctaacagcaggagcagacgacgaccagtagttgccgttgctaccctgattgttggagcctccagtactgttgttgcggttgcccgcagcaggcaagataagtaacctctgatgaattatcggaacagatgcacttaagcaaatatgctgataaccgggaaaattaactagcagaaacgtggatacgccttattcatcctaacgtctgtttactctgccagtgggttactgaatttacaagtctctctaccgataaccttagctatcggtactccggacaagaatcgcccttctatttattttttttcgctcgatttatgccacgctgccagttgcttcgagatcgactcgatctgctcggcagcagtggcatactgtttgaggttgatttgtttaaggtccatcaacaagcgtatttgcaattttatcactaccacgtgctcccttgctttcaacaaatggggagctttctgcgtggtggcattcgcctgatagatacataccaataaagcaatcaactcgtttttcacattttcacccagtgtataacggtaatcgcgttgaaaattccggttcaaccggaatatagtcaacagcagatcgtatgaagccttataaacaggcagattatcgtatatcattgtttcaacaaagcctgtaaatcagaaaccaacatcatacactgtaaaggggaagccgtttcgacgcggaaggcagacaactgtgccaatacgcggcgttcggcatccgaaaaacgggtatccggttgcaccgtaagagtaacagccggactcgaaaccgaagctgacgcttcggtttcgagaggaagtgcctttttccagtcctcaaattcatcggttgtaaaagcagtattcaaaaaaaaagagatctgcttttcattgatccgcgtaaattctcgtcccttcaacacctcctgcaagctcccatcgggaaaacctaacgagacaacttcgctgttcacattcttgaaaaagcgcttttgtaatttgtatgctttaatctccttcgtaaaccgcatggctgattgctcgtatgctttccaaaacattccctccatatataaaaggactaatggtttgtcttgctgttctgcatctattttctctttcaggttcataaataccatttattacttgttagaccaaaatcgacccgcctttcggcgggtcttaagaaataatcaaatcaatcaaattaatcggatgcgggaggcaattcgcctccctttattcttggacacaacgcaccgagaagccgttggcacggtagttcgcgtccgcattcaacccacctgcgctattgaagctcacgaggctggcgttgacgctaacagcaggagcagacgacgaccagtagtcgccgtagctaccctgaacgtaggagcctccagtactgttgctgcggccgcccgcagcaggcaagagaaggttctttccgctttccttgccgggaacggttaagcgtaagttggtagcatcccaagttgtaccggattgagctggttctaatcctgcaccgatagcaatccattcagcctgagtcggaacgcgccaaccttttgggcaaggatctgttgctgtattctttacgacatcactattatccttaccttcattaacattccaaagctgttgataccaagcaccttttcccatatcggcaccagcagggttaggattaccctcaccgttgatctgcaaccagttatactgaagggcagatgtactgtaaataaatttaccgtcccacttggatatgttagcaagatctgcctgaacagggcgacccaaatcctttataccagtggtatcggctgctgttgttgaagcattgttagtagcagtaaaaccatacaagcgtccccactgaaacaacttgccgcaatcggcagtaatatctgtattagctgtggtaacagctttattatttacagtcgttgcaccaacattaataggagcccaatatttgccatccttcatcaacaccgggttggcattggctactccgttataaaccggacggctcttaatcgttatcgtatcgcaagcactcagattaccaccgttttgaacgattacataaatatccaaaggaactctttcatcatcattctgcttagggatattgatcgtgatcggagtttctaccttagcacctgcgtaagtgacaatggcatcgcctgctttcgctattgcatcgctcttgccaccgatagaagaagcatccgcatcgaacccataagctaacttcaccacagaagcggttgttccgatcgttttgaaggtcatgcttccaccggttgctgatacattcgttatatccaatgttttcgctccttccgcccagacagcgcccttcatatcgacttccacaaagtctgaaagtacaggtttcgtataaacaggtttcaccttgatcgtatcagactcagaccattcttttaccacgatatcccatgtgatatccgtactgtcgggagctgcattgatgttgaccacataacggtggttacgagccagggcgataggatcaccagtcgtacctacaccatccgctttcttaaagtcaatcactttagaaatcttaccaccacgataagtcccgttgatctgaacggctgttgcagtagctgcatcagcattgtcattctcataagcatacaaactatccaacttctggatgatgtcaggatcgattccttcttcgactaccgttccgcttatttcgaaaggaacagaagatacatcctgagcaggcaagcccgttgaacccggcaaacccggcaaaaggtaagaagacgttttgggacgaaccagctgagcggaggtcaacacaaaaccggcggattcgtctgccttgttataagcattgttatgaatgtcgatacgagagaccaaacgatccatatcgaaatccatcgaagcagaaccaccaccattaccgcccggctgacgtttccaggcttcgatcgttttagttgaatacattaaaagaggggtctgtggattcttagagacagtttcagacaccaccttacccaactcttcccagtttgtcacggccttcagtttatcggccaagccattctcaagatagtttgcgataacgatcacctggggattcttccaaccgtcactgtggtgacggatcttggcggtatactcacccggtgtattggctacgacttcttccagctcttcctgcaaaccattggcagaaagaacctcttcatcgctgaaataaccgccgaaagcaccgtactgttccactccgtcaacagtctctgtttccgtattgacaaagaaagcaacactgctgatggttttctccttatcataggctacacctaccagcgtatcaccaaccgctctcgttttttgagcatcagggtattttaaggtcagcgtaagcgcgccatagcccgcttctacaaaatcaggatttgtcttgattagttcctcactatcgttacacgaagcaaacatgccggctaacaataaaggaaccatggctaatttataattcattatttttctgttttaatattattactagtttgtctaatcttaagcacccggttgagtgacagtaaatgttacagatactgtaggatgagctttgttcttcaatttaatagtagctacacgctccgatccggctgagttgtcttctgttccgtcagaggccattgttacagttatggtgctggcatccgttaatacagcgcttacccaggcattgctgccatcgttttcgatttcccattcaccggcatcagcaacaccactattgatagtgattgtagaagcactcaggttagtaccatctttgtcgaccgtcagggcattcgaagccaatactggagccgtgggcaatgtttcaccggcctgagttactttgaaagtaacagatgcattagcatctgtgccatgcttcaatgtgaatgtggctatacgttctgtggcacccgttccggaattgtcttcgtttccatcgctggccattgtcaacgtgatcgttgtctcgtcagtcaacactgcacttatccaattgtaactaccttcgatactccaattgctaagctcagaagcatcgataccgctaattgtgatcgttgatgcactcaggttagtaccatcgttgtctaccgtcagggcggaaacacctaaagtaggttttgtcaccggagcaggagcaggatcagctgcttgtacaaatgtaatttcctgatagattgttgcatcctggacgttttcgatacgaacaactgccgtacgttctgtggcatcaactgccgtatttgctgttgctttcagatagaaactaccgttctggctctgaggaacaaggattattgatccttcctgagtcaaccaaccggctgcatcgaccggaataacaaccttccactcggttgttgcattgactgtgaccttacgttcacctacatgactgccatctttatctcccttatccgtaaagcctgtggcaggtaatgtcactttgccgttagacaggccgatacatttggctgtaattgaacccagattctgagcggcctgacgaacgattagtttctgtaccagatccgttttcagttcacccgacttagcgattgtgattgtgatcgtatccactcttgcgttatctttatccgtattaggagtcggggctatagagaaagtctctttaccggttccttcaaaagtagaaccatcaacggcagcaccgcttttcaaggtcgattcttttccgaaagtgaaccacgaacccgtttttgtggctgtccatgttgttcccgcaggagcggagatcgttacgttcaaagaatcactgtcggtcttttcacccgaaaaactcaacaggttgccagctacggcttttccggagatatcaaggaaacggccggttgtcgggtcctgagcggcttgtttgatgataagcggctggcggatagagggacggtgcacgttctgtaccatgactacaccctggcgttcttctttgctgctggggttgggtagcaaggtggttaccttaaactctttcaacactgtatcgcctgcaagtacactgacaccgatccagtctttgtactggtcttctacgatcagttcccattcaccatcggcagcaacggctatcgctacagagtcggtaagggtcggttcggcaacaatagataatgtgttattggcaaaaccggcatcttcactgctgagcctaatggttccgtcaccggtattaacattaacggtatcacccacgatccattcaattaccttcaaggttgctgtcagttcaccactacccaggtcttccacctccaccagataacggttgttggcttcgacgtttaccactgcatccgtcttataatttttgaactcgacatccagtacctgggcagcatttgtaaccagattcgttccaaccagagagaaagcaacttcgctgcctgtcgtcatcttgatcggatacagataaaacgcactgtttgtaacacccgcattcgaattcttcatcgctgaaaaatcgatgatgggcatctctgccacgatcggagcagtatacgagtcacgtgggaacaaaggaacattacccggtacatcggctagagcaatcttgctgatcacaaagttagacgtttcgctgttgttcttgatgtcgaaacgggctacgcggcgggtaagctctaccttaacaccggtgccggcagtattggcatcggctaccgtctgtgccacatccggcatatccacctgcgcactcatcagcatcggacaggtgatatgccctttgagcgtattactcatttttttcttgaattcagccgtgtcggtatcatgcaataccacactgtcgagcgacagatgttcgcgagcgttggcaacaaagaagaaggctttgttgttcccggccggaacactgatctttgcttgcttgtcagacccgttcgtcgtcagcgtatacccttgtccgctacggaagatctcttccaacaccattggtttgggactggcaccattcattgagtcgacaccgaatacgtaaatatccaatgtgctaagttcattttccgcatccaaagccgttacggcatacggaactactccctgggctgtaccggggaacacaaacgagagctcgcgactacccgtttgaccctgaccgccatcaaggcccaaagaatcattgtcatcgctgcaggaggacatcagtagacccgcaagcgccatcaaataatacttcattttcataaatcataaaattaaattgtttatactgggcagcccccaatggctgcgattagatattcttcaataactgcaaattcctgcgtgccaacaccggtttataaggtaaggctttgcgaaaccagccggaagcgctttcggcatcatgctccataagagaaaggacaccaagattaatccatgcacgcggatcattttccacacgactcaggaaaaaacgagctgcttccgtatcttctgcagcaagggcggcagcgccggcattaagctgtgcagcagcgcaatcaggaaaacggtaagctgcctgttcatacacttcacgaaattgttccgtaccggggcgaaacacaagagcgattgtctgtaattcatccaatgtcagttgctccgggtggttgttaaataatgccagtaaacgattcaggtctgttgtattctccatcatatctgtattgtcggtagctgggatctcttcctgcaactggtaaataacctcgagttccatacgccgtaaacggccgaacaatgtctgttccatatctttccatacgcgccccttttcgatggctttcaatgctttacgtcgggaatcggcatccggggtctgagcaaacacggtagtcacctgcgctgcatacggctttcgggcttccgatacaagccgttgtaatccatcccaatcttccatacatccaccgacaattatctttggctgtggaataccttctttccgactcagataattactgaagcgtaaagcccgtccggcagcaagctcttcattgcgtttcgtatttccatccggcgaagcataaccggtgatgcaaactgtctgcaaattaccaccggtctctgccatcagtatggcaagttcatgactgatacgttccagttccgtacggttacctccatacgacggcaacaactccgtactgcccggtttaaaagaaaggacagcatcaagcctgcgcgacacggcttgcgtcctatccgccagttccccgtcacgggctgtcttttcactctccaaataatactcgatcatctgcccataaactgaagcagcgtctacctgtagttgagcaaccgattgcatacgcataagaggtatatgtttttgctgtacttctcccgcaccctccttctccacaaacgagcggggagcggaacaccctgtcgctactacgaccaacaaagcaattgcctgatgtttattcataaatcctattattattgttcatatcattcctcctatcgaaccaccgtccacccagtcgcttactgttgccgacgaaacgatgataccaccgcccgcatccacctccaacaccagactgaattcctgacgcaggttttcatccagatcgatctgcatcgtgcggaaatatttatataagtcgatctccttaatcagaagcttaccaccgccgtaaagccgaagcacagggtggtcgtcgctaccgatacggtacgttacgaaggtcgcgttcacactatgcgttatatccattttgactggaacctcataacttatcaagggataatcatccgaacgttccggtatgtaataccagattccggaacgcgtaggactaccgtcggcggccgttccatacgtcgagtaaggcgacccttttacctcaaaggcaggcgtgaaacgataaacggaaggcatattgttaagcgacatatacaaatcaccggtatcggcaggagcctttcctttccacttcaccgttacatccagtttcaagtgcgcatgtaccatatcgatgcgctgccgcgaaacacccctgtttttgatcgtgaacgaggcatatccgtagtaaagctgctcaccgttttgttgtcgcaatggtaaatctatacgggttgacggcggaacgggattgttggcatacaataggatatcagttagcttcgttcgccctacctccgagtcattcagactactacaactatccagattgccccaagctacgagcgtgtacctacccggaggcaggtttaattcggcggctatattcttttttcctcccagttcgtttacctgacggagcacttgtaaggagtcgaacacaaactctttcatccggtagatataatcgggtaatatattggcctggccggttccggtataccagtattccaagcgggcattgtaaggacattcttccagatccctgtcgatattgcaggaagaaataagcatggtcaggacaaaagacaagagcacaaaccacaccactgttgttttacggttacttctcatatctttcattatatattatatttatctccatacgccgcagcttcgggaaaagttcacggagcatttctttgtaaggtactcccccgttcagatccatcaggtaacgttcgcgtccttcaaagatgccgtaattgtctattataaagcaggtagctttttcataagatttaccacggattaaccggcgcagtccttcccagtcttccgccacccaggcagtacggaacgggtaatcttccaacccgtatgatttagtcagatagctacgaaaacctaaagaacgagctttggctagtgcttcgttatcgtaataagcaccatcgggcgatgcataacccgtaacacggatttcctttatatatatgtaagggttacccaaaagcggagtaagcaggctgtctaccttcagcaattcacgccggttacgaccaaaagcaggatctactctcgaaccgccacgcgggtagtcgatataaagggtagcggcagcgacatgctgttcctgtgttcgagtttttgacggtggagtttcttccaacttttggatgtttacattttcagcatataaataaagattagtgaccttttggaaagtgtctaccgtttgaacctgcataatctcctttataattttcttttgcggaacaacagcctcccgtttcggattatcctgcatctgttgtgtgataacatcttcacttgccgctaataaagcacaaggtgaaggcagattgatatcggtggttagtatgtcgtcagccaacaccagttcggtacagcaatccttgctgatttgctttaaacgcaattcggcatgctccatccacgaggcataagggatactgacattataacgaagggtgtagttatttccacgtttgacaccgatccaggtatgataagcgagcggtttgttacggtcaggattcaccgtttcttcacgacgatcgaaacgggcacgacggctaccggaaagaactaccggaggaagggccacctctttctttccgaaatggagtgacgggatcaacgtcagagactcttcggaagggatgcggataccggtagcggtgatcttcaggtcgatatggacactatcgtcacttacagtaaggctctgcgggatgatgcggatgccgtcgggagtaacctctttggcataaagggtggtgctcattattaaaagaatgacacacagccaatgacacaccccctgacccctctcgagaagggaaagaatactcccaacactacctgattgtagtatctgatggtaacttttcccctctcgagaggagacagagggtgtgttaatggcttgtctcataccaatcaatgtataatatagataaaagaaacccccaacttcgtaggtccgaagaaatgccgtttataccggcccatcagttccgcacactcagaacatacatatttattatattccaaataggtatagccaacacccgcggtcaattccaaaccccaacgacgccctattgcaaaatgataaccataagaaacaccgccaccataaagttcgccacgataagtatatgtatccagatccggcaggaaaggaatctgtccgacattataacgaccgtaatgtccatgcacacccaggaagtgtccttcgaagcttttacagaaccagtaacgaagttcaggctgtaccaaccagtgacgcagactcatgccatctgaaaagaacgtccaggcattgtaatttccatctacactgagagtcagcttcttactaatcgctacctctacacccagattcggtgttgttgttagccaccagagcgtattcgtcctgactccaatttgttggctatgcgctacgacagccgacaattgcagtaacaaagagatcagcaagagatttaccctgattttcgttcttaatcccgttcttttcatatcttctaccctatgtacatgtctcattcttagtaagaatgagacatctttaaacgaagatcgtatacttgttgaattacaacggattaaagatgagttattaaatagaatagtatttttagacaggcgtttttcttctgataagatttaatttaaggttactttttcatatcttttatttgtttattaaataataacatgtacatttgcaggaagatagcctttgaataataaaggctcaaaaaaatcaaccagcagatgtctcattcttactaagaaggggacattttttttctttctctattgatttctttcttatcaatctgtttaacatctcttcatttgcattatcaatcacacgtgaaggcattcctctcatgtaagttttcgtgactcgttccgagccatgccccattccctggctgataatagcgatactcattccacattcttcgatcaacgaggcccaactgtgtcgcgccacataagtagttagcttcaatcccaacatttctcctatcttacctaactgacggttgatacgcctcagtgaacttttttctgaaatatcttttccaccatacgagttccttcgtaaaaaaggaaaaacatagggattatctgactcacgataacgctccatgatcattttcatttcaggcacaattttcacctgcaatggtgcagaagtcttacttcttttgtaacaaatatactcaccgtttatagagtcataacgcagactaaacacatccacaaaacacatacctcgtgcataaaacaggaacataaacaggtcgcgcgccttacaaagttctttcttcccggaaagatcaaggctgattatgtctaaaaccgcctttttctctagtgagcgtttcaaggtggcgggaacaggtatacgaatattcgtaaaaggatgattggaaccggcaggtatcgaatacgtcttcaccgctttattgtaaaccgcacgtagtatacgacaataattatctacactagctaacgataaacttccgcttttctgcatgtgcataacataagcattaagccataagtccgttatatccttcaccttgagcttatctactttttttcctacaaaatcacaaacggaacgatagacgttccgatagttgtcgaccgtaaattggcttttacttttgccaagataatcgatctgatctttaaatacatctgctaaaaacagatctgctgtttgattttttgccatctatgtcatatagttattattatgacccaagaatacgcacttttccccaataagccaatacagcaaaggttatgaaaagcaaagaaaataaaagcctatccccctgtcagataaccccaataaataatgcagagattgaataatatgacgaggagaaataataacacaaaaaaataagacgaccttttgagtcgtcttatccattaatataaaaaagtactattatttctgttctttatagtctttacgataagaacactccgtttccgtagggaagtctttcggcactttctgagtcacctttccggttgccgcccattcagcaccacgcaacagtaaaacctggaaacccgtacattgcatagctgtattattttcagctgtctcaccggcatgtccaagcatcgtatggaagatacgggcgttgccgtaatcgacagtgaagatcagcggttcctcgcgacctgatccgcctgtttccttatcagaataagaagtatacaggagagcatcgatattacccggcccacgcatacgatcatataattcatcctttgtatgacgccatttcagaggtaaacctttgacgatcggatgcactttatcacgtccattcaaaacatattcatgctggctgccatgtgagcctccgggaccggcagaactgtctttgaccagtttgccatcctgccagtagacataagggcctgaattctcattacggttttcccaacctcccaaagcacatatcttattgaattccggccatttggaaaaagcattatcagcggcatgatagatcacaactccgccacccccttgtacataatcgaggaaacgtttgtttgtttcctccggccaggagtcaccattataatcgagtactaccagttcataaggagtaaaatcaagtacaaagcccgacatgtcttttccctgtgaaggagaaaccgcgaaatcgactgagaaacggccggaattttccagtatctgttttaacaccacatggctgacctgccagttatggttattctgccctgttattaataaagttttgataggtttcctggctgacaccgagcatacacacaacatggaaaccaacacaatgaacagctttcctaaaaataaatgtctcatggtattaatatggtttaaagatttgtaaaggcaaatgtagtaaaaattgacagtcggcaattgacaattgacaattatttggttggagatcagaaccaaaactaaaccaggcttgtttttatcgagcttatgaaggtaaactggaggatattaaagctgaaactagtggatgccaggctctatttcgtgagtctcatcgtaggattgctaaccggcctggtagcagttccttaccattatttattgcagctgttctataactaccggaaagatttttttgaatcttctcctccctggtatcttcatataatcgctttcttcactttgtgggctgtgcttatattcgtatcaaaactggtaagacattggccttacataggaggtggaggcatctcgcaaacacgcggagcaatcaatggcaggatcgtttacaaacactcgttccggcaattactggctaagtttgccggcggggtactaacattaagcagcggactttccatggggcgcgaaggaccttccgtacaaatgggttcttatataggcgacctggtcggcaagtgggggcatatcctgagcggagaacgaaagcaactactcgctgcaggtgccggtgccggactggcagcggcctttgccgcaccactggctggcgccactctggtgatcgaatcgatcgaacgtttcgacgcacccaaaacggctatcactactattctggccggagttgtggccggtacgattgccaatatgatgtttccgatcaatccttatcatgagatagaggctatagctcccgaactttcattctctctacagatcaaattgttcctgttgtttgccgtagttgtttccatcttcggaaaattctactcactactgatgctttatgttaaaaggttgttccctaccatcaaacagcccgaatatataaagttgttggggctattgatcatggcgtatgtcatttcgctgacaataaccgatcttacgggaggaggcgaacagttcctgatggaacaagcattgggcggtaaacaaagtatattatggattaccggcatgatgctgttacatatggtgtttacggtctattccttttcttccggattacccggaggcagttttatcccgacactcgtcaccggtggtttgcttggaaagatatgtgcgcttttactggtgcaacatggaattatcgctcccgaaaacatcagttatgtgatgctggtcgggatggccgctttcctggtggctgttgtccgtactcccatcacagctattatactgataacggagatcacagggcattttgaggtgttctatccttcaatcgtcgtcgggggattgacttactacttcaccgaactattagaaataaagccgttcaacgtaatgttttacgaagagatgatcaagaagcctctctttcaggaagaaaaacggctcaggctggatgtagaggtcatgacaggggcctatttcgacggtaaagagactgataccctgcatctaccgaacaactgcattattataaatatccaccgagaccgcaaagacttccctcctaccggccaaactatcatgcccggcgaccagttaaccctcgaaatagatgcccaggatatcgaaaaattgtatgagccattagttagtatggcgaatatctattaaataaaaaaggtgtctgaaaactattcaaacacctttttatcctattatttatccttaatcaggcaaagaacaaaatcaataactgtgccgtcaatacacgcaggaacattgtcaatggatagacagttgcataccctacggaaggagcatcgtttccggctgttgcattcgaataggccagtgcaggcggatcggttgtactacctgcaatcaaccccattaatgtaaagtaattcaccttacagaaataacggccgatacatccgatgatcaacaaaggaactgtcgttatgataaaaccgtaaccgatccaggcaaaaccaccgttattcacaatcgtatcgacaaagccatcaccggcactgataccgacacaggcaaggaacaaggtgataccgatctcgcgtaacatcaggtttgcactctgagtcgtataggttatcagtttatatttataaccgaaccggctgatcaggatagccacaatcagcggtccaccggccaatcccagctttaccggttgagggatacccgggaatgtaataggtatactacccaacacaatacccagcgcaataccgataaagatcgtgatcaggttcggctcgttcaaacgtttcattgagttacctaataccttttctacatttgtgacagcagtctcggtacctactacatttacacggtcaccaacttgcagtgtcaggtgcggagtagctaccagatcgacgccggcacggttgatacgggtaatattgataccgtataactgacgtagtttcagttgtccgagacgtttaccgttcaactcaggctttgtaaccaggatacgacggttgatgaactggctttccatacgaatccactgtttgcgttccatatcgatcacttcgccgacgaaagtcttgatggtatcggcatcctgttcggttgtaattacaaaaactttatcgttctcatgcaatacggcattagctgaagctatttcaatctgtttgttgttgtcatgccagatacgggatataacgaaatcacgatgttccagcaaaccggacaactcccctaccgtttttccaaatattgccggatttttaaccaccagggaaataggtttagcctcattagcatgagatgaatcctcattatccagttgttcattctccttgtcgaagttcacacggaatgcataacggataaacataatcgaaagaataataccgatcacacccaacggataagcaaccgcatatcccagtgcaattgtattatcagctgtaccatacatatcggaatatgcctgttgagcagcacccagacccggtgtattcgtcaccgctccagacaaaataccaaccattgtgggcattggaataccggttgtgtaatgcaagataacagctgttactactcccaggaacacaattccgcaagctagtaagttcaaggttattcctcccttcttaaaagacgagaagaaaccgggtcccacctgcatacccacagagtaaacaaacaggataagaccgaactctttaaagaagtgaattacattgtggttgatcgtaaaaccgaaatgccccagaatgatacccacaaacaaaaccagtgtaatgcccagagagactccaaacaccttaattttacccaattgaattccggccgctatcacaaacgacagcaacagaatggagtggccaatgccttctccccataataaatcattgatccaattcatattctaatattaaaaaaccttgtcactatttaataaagtgggcaaagataaccatttagtttgtgtttaacaacataaatactatctttacccggcaaataaaaatagaaggcatgaataagatatactacttggttttactactgttcgcaatgtcagggtcacttcacgcgcaaggtgaaggaaagacagtaacaatccaaacgaatgtggggacgatgaaagctcggctatacgacgacgtgcctaatcatgtccgtactttcatcaaccgggcacggcagggtgaattcaatggtacgctttttacccgtgtcatcaaagaatttatgatacagggaggtgctcccgactcaaaaacagctcccccgggtgctcgttgcggtttcggcgactcgtctgccgagatactaccggaactgaacagtaaatatttccataaaaaaggagccttggctgctccccgccaaaacgatgacgtcaatccacaaaagaaatcggatatgtcgcaattctttatcgtacagggaaaagtataccgcaacggagaattggatacgctggaattgattgcaaaccagaatatccgcaaaaaggccctcgacgaattttaccgtccggaagccgtagagctgaaaatgctgaaacaaagcaacaaacgggaatacaacaaacgtatcactacaatcaatgctaagatcgactccatgatactggctactcccggacatttgatctttaccgacgaacagcggaaagcttatacaacaaccggtggttgtcaccatctggatggcatctatacgattttcggtgaaatgacggaaggtttcgatgtattggacattatcgccaatcagccaaaagaccagtatgaccgtccgcaaaaagatattagaattataagtgtaaccgtagaataaaccccattccatatgctaaaaagagattttatcatggtacagatcgaagaactgggcaaaatgatcgcccaggtaatcttcaaccgcaacaacaatacaaccgatagaaacccagagttgatacaggatgtttacgataacctgaaagtggatcgtaactatctgatgacaaccgcgcctgacgatatcctccgattcctcgacaacgaagatcaaggaggcgtattacgtctcgagatcgcgatcaaaaccttgatcgaagacggccttcaacaacccaaagatcaatgtgaaatgcttcttcgcgcaaaggagttattggaatatctgcaagctcacgatacaactttctcactggaaaggatcaacctactgaatgatattcagcaacaccttctgcacagcgttcaccatcgatagccgcagaaacaatccctccggcataaccggctccttccccgcaggggaaaagtcctttcagggtgatatgctgataggtatcgcgatcacgaaggatgcggaccggagaagacgtgcgggtttctacgcctatcatcagggcttcgttagtcagaaagccccgggaagtttttccgaaatgacggaaaccatcacgcaggcggctggttacaaattcaggcatccagaaatgaagcggtgatgccaacaacccgggtgtataggaagactccggcaaatcgaacgagtttttcttcgtaacaaagtcattcatacgttgggccggtgccgtctgtttcataccaccattcagccagcatacttcttccagcctttcctgaaaagccatcaatgctaaaggcgaatcggcaggaacctttatctcttcatgcttcatcagttccggataatcttctggtcggatctcgaccaccattccggaattcgaccagcgcgaacctcggttagacggtgacataccgtttacaacaacttgtttcggaccgcttgccgccggaacgacaaatccgccgggacacatacagaaagaatacacacctcttccgccggcctgcgtaacaaagctatattcggcagccggaagatactttcctctcccctccctacggtgatactgaatttggtcgatcaactcctgcggatgctccaaacgaacacctacggcaatacctttagcttcgatagggatcttttgctcataaagatatcgatagacatcacgggccgaatgaccagttgccaggataaccgggccaagaaaggtctttcctgtattggtttcaataccgacaacttcattgtctttcaggatcagagcatccatacgggtttcaaaatgaacttcaccaccacaacggatgatctgctcacggatattttctatcacacggggcaatttatccgttcctatgtgaggatgggcatctgccaggatcgatgtgctggcaccatgctgacaaaaaacattcagaatcttatccaccgaaccgcgtttcttactgcgggtatatagtttaccatccgaataagccccggcaccaccttcaccgaaactgtaattcgattcactgttcacgacatgctcacgactgatcaacgcaatatccttcttacgatcgcgtacattcttaccacgttctatgataacagggcgcaaacccagttcaatcagacgcagagcggcaaacaatcctccggggccggcaccaaccacaatcactggtttaccgcttgatacatctttatattccaccgactggtattctgcctcttccggttgctcattaataaatatgcgcagtttaacatttacataaatcgtacgctggcgggcatcgatcgaacgtttcaatagccgtacagcttgtatatctttgagaggagtaccggtttcccgtgcaacgacttgtttcagggattgctcattgactgcttcttccggcagaatacggagttgtaattcttgtatcattatttatttgcttgttataaagagaaaacgattatccaaacagatgacggaaagcctcttccactttcttcacctgtataatctgtattttacatttagcggtatcgaaacctttcaggttgttatgaggaataattatacgcgagaagcctagcttctctgcttccaggatacgttgctcgatacggttgaccggacggatctcacccgataaaccgacctcaccacacatacatacgccttgctcgatgctgatatcgagactcgatgaaagcacggcactgataacagctaagtcaatagcagggtcattcacctttaaaccaccggcaatattcagaaacacatccttttgtatcaatttaaatccggcacgtttttcaaggactgccagcaacatattcattcgtcgcagatcgaatcccgttgcgctacgttgcggcgtaccgtaaacagcggaacttaccaatgcctgagtctcgatcaggaaagggcgaatcccttcgatcgcggcggcgatcgtcacgccactcagcccctcatgattctgggtcaacaataattctgacggattgcttacttcacgcaaaccattctgcctcatttcatagatacccaattccgccgtactaccaaaacggtttttaatactacgcagaatacggtacatataatgttggtcgccttcaaactgaagcaccgtatcgacaatatgttccaatacttttggcccggcaatacttccttccttatttatatggccgatcagcaaaacaggcacaccactttctttagcatatttcagaatagcggcgctacattcacgtacctgggagacactaccgggagacgattccacaatctcagtatagatagtctggatagagtcgataatcattaaatccggttgcacgttacgagcctgtacaaatatctgttccagatttgtttcacataagataaaacagtccggattttcatgagccagacggtcggcacgaagtttaagctgccggctgctttcctcccccgaaacatatagtgttttcaacccgttcagccccaaaacggtctgcaacaccagggtagacttgccgatacccggttcaccaccgatcaataccaacgatcctttcaccagccccccaccgaggacacggttcaattcctcatctttcaaatcgatacgggattcttcttcggatgtgatgtcgcgcagtaagaccggacgaaccttttcgttgtcggttattccgggaataatacgttttgccgagggctctttagtggtgacgatttcttccacatacgtgttccattcaccgcaattaggacatttaccgacccatttaggagagtctgctccacaattggagcagacatatactgtttttgtcttagccatacatctttaagatttggcgtaaagataggaaaagttagccaaataagtcgagtgtaagttgtttcttctccgcttccagcttgcgcaggtgacgcttaccctgtggggtaacgatttcaagtttatcgaaacgggtacgaaccacagtagtcaccgtatagctgacattgatcgtttcacccaattcgcttaacttacgtgcaatctccaatacacagtcgatacacatgccgctggtgaaagagatcttttcatcgaacatctgtttcttgaaatcttcgtcgcacatataaaagtcgatcgtctcgcctcctttattatagatacctttccaacggtaacggctatctttcaatacaggcgaaatgatttctatcgtcgctttattatctttgatggtaggcagatcgtctgaacgcaggataaagtaatcaaactgatcacgtttcacatccagagaaccggagcgactaccgttgtttgcattcagttcgcgtacagttatttttgtcaccttgggatatcccttcaacgcttcataaaaattggatttacacttactgaacttaggccatgaagaaagcaattcaatcagttcatgagggatccgggcacccggatcttttagtttgagcgaacgtttcagaagtagtatttccttttgcattttctcttcatcggcattcgtccggtcggcaataggttgcccccctaccgacagggtcggacgcgacagaacctgcatcaatatattcaatacaatggaaatagcacgcggactttcgccagctatcggccatactatccggtatccacctgccagcggaacaggttcgcaatgagcagtcatcttcacatccagcatatcggccaatacacggatcatggaaagtatttctttctcacaacggtgtttaatcatagcgtccatatagctggacttatcgttaaaagaataacgaagttcaagtttgttttcaaactttatcatagaatcatcttgttatttgtccaaaatccagctaattacttcacaggttgttctttgggtttacgatcgaagaacggatttttagaagaggcactgaccgggatagccatgacacacttactgtcttcaccgagccagcccaaacgctgtgcagccaagccggcactaaacatgacacgcgtatccaaacgcaggtcggaagccgtagcacaagctgatccgattgcaatacccaaatctacggaattaatagcacatggaacttctgccggtttctctacacaagtatcatatccgcaatgtgcacaattcagtccttgtacctgctggcgcgtaccgagtatcactacagcctcggcactcaggatgttatccgcatcacgtaagaaaaactttaatcccgtctcagcagccaccttaagcatctcttcggacagatgccggatatcatcacccgttaccattgcaatctctataatgtcgacacctttccctttcggagccgtccgggcagccgtcatcatctgacggacagcagttaacacatattcgtgtcgtatctctctttcgttttgtatcatttctttattggtttagcaggaacaaagatacacttttactcgttttcaagttcaagatttgtcatcttttctgtgatctcaaacggataatcgggatattcatataaactgaaacgtggttccgtgacgccttcgcaataattccagatactacggtattctttcacatcctctcccaattcttccaactgccggagataggctgccaccgatttattctcgacaatgaacacttctcccatctgatgaatgatcgggctgtgccgacgaccggtatcatggtcgaacttgaggatacgcttgccttccgctgtaaatcctattgttttaaatgtcatgctttttccgattgccggtaaattcaatacactccggtcggttgcagcaaataataaatgattgtctctaaggaaactgatcaactttttacccaacggacgcttgtttgttacgatatcatccagttcctccagtttatcttcaggaacatgaccgaataccttctcttcgtattgttcctgcaatgaacggctgttaggtgtaaatacggcatagttttcgttaaagcctttcacagaaaaggtataataacaaatcactccgacggaattcaaagtctggcgtagcttagccgtatgtccccgtcgggatgcagctaccgtataaaccaactggttggtaataatccatccggcatcaaggatcgcctgtatggctcgtttagcttcgggagttacttccaaaggagactggaaatgggtctggataataaactgggaaacaccaaccgtagatgctttgtctttaaactccttgagaatggcaaccagttcgtccgttatacgcaacggaagataggcaagcaaacgtgatcccaaacgtacgcgttgcaactcggcatatttttcacctttcggacgttcttcgttggctttccgtttacgaacagccattttatatactgcctccaatatcttccgtagtgtagcattctgactcatcagtgcatctcctccggtgatcaggatatctcttaattgagcatcttcttcaaaatagtgcatcaaccggcgcagcttcttatcccagctttcttttgcttttaatgcttcgaaatcaaaattcaaacgttcactttgaaaatcgtacattcgctgacaggaagcacatagtcccccacaagcccggcccatcgaatccggtatcaggatagcaacttcaggataacgacgatggatattatgcccttcgggcagcaaccacccggcagcattgggttgcccggataccactatatcctctttttcccatgctttgatacttccgtatgtctccaccagttcttcagaatacagtatatacgaccggattgtctcatcatcatatccctcttttcccggattaagcaacgacagataataaggggtaacaaagaatggcataccttttttccgggcatgacccagcaattgcatcatctcctccgacaacgaatcgcccaaaaaataattaagttctttgggacctttgatggccatagccaaatggaaacgtgccgtattccaccattccttcacctggtcatatttctcctcctctgtcatttccggagaaaactgatatcgggacgatggtgcgttacgacgttctattttacggatcagtcttctgattatccgttctttattcgcttcacgaacagctaccacttcctcatccaaccctgtcggccaacgactcatttgccgttttacctgcgagcggtcgggaactatttcttccggacgttccagcaacataaattgatgatacaaatcgatgaaaagatcgggagaggcattatcagtcagtttcccagtcaataactgccagaaataagaaaaagtatgtatagacagttgctctcccgttgagagttcatccactgttgtctcatcataatccaataaaagtaaaatacgcttcgccacggcattccccatattactgcccccttcacctgtttcaagccgtgaagagacaaaagaacgaagagcttctctaaacagctccacgctccggctctcttccgccattgctatcaaatgaggaaaatctctgttaaacacttttagtaaataagaattgtcgtacgttagttcttttcttttaatcataaacatcactgctttttagatagattagaataattcaagtctcagatcgctcattcaaacgcgattatattataaaggatagttcatttcccgaatcacaaacaacagacgaagaagcttagacttttacacttgtccacaaatataacatttttcattgaaaagcagcgcatattcacttttaaaacattctagtttatgatgtagcaggatcaaaatgacatctattttactatttaattacactctggtttcactttcaccagtttcagtagcaaccagccattatcttttttacatacgtcttgaaaaaaagcgatagcgcttgcatttatcaaatagtatatatatatttgtcacaaagtaatatttgaggcttaggcctctcgtttaaggttaaggtattggtcattataagaataaaaaagtctacttgtgaaagtagacttttttattaaccaatatccaccccatcaccagcaaaacaacgcctccccaccaaaaagacgataaaacctttgtcactttagaagtaaccaccttttctttattaacagaaatatcttcttctttatttattttacccgaaataacactaagttcttctgtttctttatctccttctaacctcgttactgaacggatatattgtctttgtaaactatcaggtggaaaaagttcgatatgttcaagacgaagcttttgttgacaagtggcttggagttgttgcgataaagaaatgctatcggaatgagtaatggtctgggtcaaaacagagctacgcaggatacgctgtttgttactgagtcgtccggtatgacaaccagacgacaggagtaagatagacagcagaataataatagtcaggaaacactttttctgatacttcatacctaattcttttacttgtataatatttgacgtctttgtttgccattcactttgtaagacaaatgaaggaaatgttttttacggtaaagaatagcctggtcgaaagacaatccgcttttcttcagtatatccaaaagaagataaatatccggcacataacaatcggctgcttctcctttcacatgctgactggaacggacaccaccggccagacggtttacctccagactgcgatagccgctagtgatagcaatgggtttgttataagcaatacggaggggttgaagaaggcatttcaccagttctctaatagcatcgcgagcctcttccggaggatcatttctcaaaccgttcagtacagcaatgttgctgtaagtcatttcctcccatgtaaaatctctgctaatgttctttttcatcttttatttgttttattttgtatgaataatcgacgccaaacagggcgccggcaaaggtgctgatctcaccaaaagcaacgagtacgctattgtggatctctccggcaggggctatccaaaaaccggagaagagaagaacaatcccactcacaacgagtaggattgccattagtaactgaaccgtcaaccgcttcatctgactactcgattaccggacgatcgtcatcatctccaccgcccgtattcggtttgttttctttcttgtccgattcctcttcaaacttcgtgatctcgttcgaccagcgcaagctcgcccccggtgtaaatacaatacgtgcctttttgattttagaagcattgaactcgtcagcattctccgtaccggtagatctcaccgacaaacggaaattaccgaattcccctacctgtacgatatttcccgaacgaagttccagccccatagcccagttcaacgagtcgagtatcgcctttacatccgcgctcgacatagcagagcggttagagatcagctcacacaactttgccatatcgcaatagcctgatgccttagccattgcataggttttcactttgtccttgtcgaacatgatctttctctgtactttcttaaattttaatgccataattttatgatttaaaatgttacgtactctttcttgagcacaatacaaaggtattacggcagaaaacggaagaattcctgaacaaagactaataaaaagctgataatctgatgtaataaacaaaaaagtcacatttccgcgaacaaattcaggaaagcaaatgagatgttttttataaccttttagaaaactaatcactttccaccttcacctttcccatcagggcaaggaactcattcaatgtatctgcgtcaggttgggagtggcagaggtagttgtccagcgtttccagtttataagggatggagaatgccagtaagaggctggaggctaattggtggtacatgacgcgaccccggtggtcggcattttcaagtacgtataataaaggaagaaacagctcggggttgtgtaaggtgtagcggagtttagctaagggagtataatttagcagataatcgatatataattcgcggtcatgcttcaggtaagcggctgtaaattttcgaaacggaccgggcagctggtcgtaatagccgaaggccaggcggcagaggttcaggcgatactgctgacgaagaggctcttcgagagttttcaacttagtgtcgaacgatgcaggaggtggtgcattgccaaacagcaactgcatctctttcaatagctttttcatgacctaatccctcaaacaaacgcagtaacttacgggacaacagcggttcgcacagataaaataccggataacaagggaatgattagccctcgttatccggcacactattttcttcagatattatttgcttgcgggattcaggctctccaacaaaaactttcagggtttaaactttacactggtgcgggcatttatcatacagggaacaagtacctcctgaaagaaatggttaatttatatcactgacacacctgacatgaagcgattgccacgtgccgccatagtcgtttaggccagtggtgaacaacactactccatgagtttggacattgccataactactccagtaatagtagttgaggaacggtgcgccgtagagctgggtgtcaggctcgttatctgtagcatcagagttagctcctttagccttatcccacatggtatacaactcgatctgagttggtaaacgccaattggaaagcccccctcagaaagattcttacaataatcccgagctacaaaatcggcaccgtctagataaggtacacggtgcgggaattgcgtactctgcacttggagacgataacttccgatcatagtaggggttccccaagtaaaatcgacaccggggtgattgtctttgatccactgacctccatcaccatctatatcgaacggaggatatttagactctgcagcatacttcgtcaatatttcctggtttatcgttaatatcggattggctatttgcttgacggcaaccatctttttatggtcaccacccgggacggttatgttaaatgtatcggtgcgcggcggcccgaaattctcgcgggctgaaaacgctatattctgattctgaccggttacatcaccattaaagagtagcggagctatctgtttcgctccatcatgcgggttaacttcccatgtcaacccctttgtcccctttataacagcattaaaggttgtagccgtaaagttaatttccatggttgaaggcgaaatgagctcaaaggtagaacccagctggctcacgactatctttcccttgggaccggactcggggttacctgcttcaacggtaatacctcccgaccggagggtggagttgggattggcaactacatcaaaagtgatagtctgggacgaacccgttgtcggcgtgcctgaaccgccaccctttacatggagccaggtgtcggctccaacacttgttcgccagtccagacccggcgtagctgtgaatgatccggtcaagttgagagcaccctcggcgactatattatttaacaccgtgcagttggttactttagaacctttctgcacgacagatgcctctttattaagccccgtatacgtgttgtcggctatagaagcacccgctttcagcacgattctacctccacgcaatgcggcagacggattcgctccgtcagcttttactttcagggtttgctgctgaccggttgcttcaccttcgattgcgagattttcaggtgcaaagatgatccacccggcactggggacagctgtccacggcaaccctttggtagtggtaaaagtggccgaacttacggtttcacccgcttcacccagcaagatattgttgttgtcaagcgtcaattaggaacctgcctgggtaagctcaaaaggttggggagtattatcgatagaaaggttgaccgtttcggttctgtcctctgctttcggattggctgtggcagcctgtaaagtcacaagaacagggccttcataggtaatggtggaaccggcgtcagcgttagtaccgcccaccagagcggatagccagacgggtaaatacatattccagggtatacccgggcgggcaggaatctggacggctttcacgctgcccttttctgccgccatcttgccagggtcgacttcgacagggggaatttctccgatcgtgatgcggtcgtcggaggcatccagaccgaccagagtaaccttcatctggtagtgggcattacgcactatatcgtaattattcatattggcacccgggaaaaagcgaataacgacattgctgtaggtaacaccgtcctgcacggcactgcctcgcagttcgatgcaggtggcgttggttacaccggtaccgaccttctgcttctcggaagtgacggcgttggaaccagtgactgttctggccatattttcgggcagataccagtaaaaggttttactcgtaggattgggattcttatcggtataatgggtataagacatgcctgcggctgttaattgtgtcgtgggagcttccacctgagacaaggccggagcattccttaagaacacggagtcaagcgtaaacgagaaaccggagctgctgaccgcataagtaaaagatattttagcgatgagtcgttttagctgcacggtgatgttatttacaccgccggaaggtatggctccgttccactgtcccatcatcatacagaggttgttgtttggtaagcctgcgtctgtagaaccataaggcaaggtgcgtgttttcaaagtcgcttcatcggcgactacgcccaggtcactggtatttgccacgaagtatacatggctggtctgaccggcggtgtttactttcaactttatattaactgtattaccggacagcctagaaaaatactggctgaacaggcgctggcctgtggctgcatcgtattgaccgacccacaggctggataattggttttcctgcacctcggttaaagggttggtagactttgtccgtatcgaatctgggatattaggggctgcggtgtctatcgccaggctgtctgactcgatcgtgccctcggcagtgaaggtgatactgcgtgttttagttgtctgattggccagtacttgcaggttgaaggatgtttctacctcctgcccggcagagggacggaggccgtctactacctcggtttcggtgcaaccgacgattaggaggaaaaggagaagaagataaaaatgattgaagggcgggcatttacacgccccctgccccctctcgagaggagaaaagatactccggacaccggtaagtgatcggtttcttgttattgattgtttcatcgtatattgtatttcatttattatatcagactgctcaagatagagtagttattgaattgattaattgattttcttaatccccgacacacctgacatagtagctacccgttgtggtgttgtagcctttgaaattgccattgtcgaagtactgtccgcaacgtgtgctactattgccaccgttctcacaggcgaactaagtccaacctgttcatccgtccacgacatctcatcccactgtgcgaccgttatcgttgtacctgtccccgcattgatatcgggatcgggacgggaaccatcggggccacccacgcctgtatctgtaaaagaaaccgcagtccagttcagtatcgtcagcagcaggctgctggtgttatcttttacgtcgagggtgaagatatagcgtttgccggggtcgaaggtgatctgtttgtcgatggtggcactcagggttgccgtttcatcgtcacgaaccactgtcagggaaacatcgaacgcggtattgtttttgggaaggacaacacctttggctttgttccgtccgtcaggatgcaggccgcttacaggctcgaagtctgcggcggagaaagtaacctcagaagccgtacctgcgttgccgcccgttagaagaataccggtactttcgcctgctatcaggctggcaccggaagtagatatttttttcaggatcagggaagtgccatacaattggtcgaaaggaagggcattgtcgggtgaaggggcgacattaaaaacaactaaggcacattttcgggcgaaggtattcagcgcaacgacgttagaggttgccgagacttcgacattacgctgaaaagaggccattacgtcctctttatgagggatattagttatttgatatttgctgcctgaaccctgttgcagggggcgtgccggggatacggcatagaaatcgtaggtaccgccgcggacggaaaggccggaagccgcgccgtctatctttttgccatcgttatcgaccatgcagggcgagagggaaccgtctgcctgcacttcgtaggttgcttcatacgtggtaccgaagtgtcgaacgaagccggctgtatcgcgccgtccgcccctttgcggagataataggcggcgatccggacagtagccctcaccggaagtcgctccgggacgagcccgtcaccggcacgtgaaacaggaacaggcctgcccaggtcgggtcgggtaaaactcagtgtcaccggacgggcgtctgccgaaccggcatctataactggctccgccgtacatccgcacaacagataaaacgagactgttcccaatagatatatccttattcgataccctgccattttcttacttgttagtttatttctgactattgtataatgcattcatatctgccggcatataagtatcccgtgcgttcaacgcttccagcaaatacttaccggctttgaatcttacactggttcgggccgggattatgcagggaactcccgtacgcggattgcgacccagacgttccgtctgcttccacagttcgaatttcccgaatccctgaagccccacaggctcttccgctttcaaggtatcttccaatacttccagaaagctgttgagaaaccgaccggactcactccggttgattctcattttttaacgctaatgcatttattaaatcagtcttgttcatgatctgttattttatggtggatattattgcatgggaatattagggttcgtaatagccgcgtcttcccaaggcgttacgccgacccgggccacttctataccgataccatcggtaaaaaaaagagagaggatatgtctgctaccggcttgaagacctccttcgacagagacagagacacgaaaggtcgtttccgtttctacaccctttccgtccttcgtagtcgttatgttcagccacaacgcattaaccggggtacccaggttgcctgccacacctgctacgggtaacaggatataccccgttgctttatcttcgccaggcagcggatcatcctgacttacctgcaacagaggcaacggataggcaatgtcttgcaccggcaatgtgcctgccgggctaccggctgcaacacgcaacttcacctccccggatactgacgtccagtccatttcctgctgcaaagggatatccgcggcttcaatctctacgatcttaccccatttaccggactcgtcgctgtagcagacaaaagagaaccaggtcagcaggtgacaaaaagtacatgggacggatgcctgatcggacgaggccttgaagtatcctgtagccatcacatccgtttgtccgtcgatggtaaaggtaactttgcccgcagcgaggtctggcacagcctttccaccatcagtcggatagtagccgtgaaggtagacgctaccgcttgccggataggtctgcgtctccatgaacacgatcggacggctaccgaccccgccgctacgcacggcagaatgtactccccaggaacctgtcacatctggtaacccgggagtgagcacgtcccggcgggcaaagcagactttcagatcctcattatagccggaaccgatcaccgcacgggtagacagaccgatcgccccctccaggcgcacggctgtcgcacgaacgggttgcggctcccggccgctatcgtccgaacaggccgtaaagcccaggagggaaacgaagatcactatcactattttattcttcatttactgctagtgattagttgggagttactaccccactacttgcattacccggattccaaggggcgatttcagctgtagctgaagccgatatctctccgtcgactgtaaagatgagcgtaatgaggtgagagacacctgccttcacgcctccttggatgttactgattgtgatttgtttactcaacgaagtattgctatgacttccattcacttccaatgtgatcggagcagacacggaacccaggtcggcaaccggacaaagcatcgtataacctattacaggatcctgcgcatccggatttgtcggtattgtcggacagttatagacattcaggtcaaccgtaggtgtactgttgaccttcaaactggctcccgtggacttattcaacaatacctccaatgtggaaggaactcctttcactttgatactgatattcttccaggctgcgatcgccgctgcagaaccgacacactggaactgtaactgaccaagcagatgctggaaagtacaattctgaatcggagcggttttggaacccgtcaagacctctgttgccataatgtccatatcaccgttgatcgtataaggcactgtaactttatcctgatcgctcgaggtagccactgttgcacgcggataataacccagaagggtcgtagaggttgtttcgttgtatacctgtgacgtttcgaaagcaactgctgtcttaccgctaccgcctacacgtacagccttaataccttcgccggcccaggaactggcattcgcttcaatacgtgcaaacgccacgggaagatcttgctcgtaaccctgattgataactgcacgggttgtctgtccgatacccgcacttaatttgatctcatttacacccgccccgtttaccggttcttcattgtttgagcaactgctcaggatcatggtagccagaaggcctaccgctaaaaacttgtttgttctcatttttactagtgtttaatttataaatataataacaaaatgaatactaagatttatatcactccggaaccgctactgcccggtatccactcggcgatacccgctgacaactggctggaacttccggcacggatcatcacagaaataaaataagaggtccccgctaccggagtattccctccctcatggaaggtgacgggtagagattccaaccgtgtcgaccggccatcgagatctttcagaacagcagtcaggtagacgtctaccccgggctgtatcaatactgcgtcgggaagtttggtccaccctcctgtaagcggggtaagttcgaccggcaccttgaagtcgcctttctctcccgaaaaagaaaggctgttatcatcgagcgacaaggaaacttcacgctgcatgcgggttacataaagaccttccagcttccagcctctctccagcgcttcttcatcgccacggacctcgaagcgaagctgcgacagcaaatgtgtaaaacgaaactctttatgcttttgctggagcacatccgtcaggcagcccctttgctcgccgctggctatcaggtcttgtgtcccatcgatcaggtagccgacttttccattgtcaaacgatttcccttccggagcgaagccgcgcaggtagacccggctgttatcttcggggtaatacttcggctcgtcaaacaggacactgccgttcggatcgaccgttgctttccatttctccgtatagtttcccgatgtcgttcctttggcaaaaaagagttgtccccgcgtaccggtacccgacaggctacccggagcgatatggagttccaggtcacccttccccatatagtcggaaggggaactgtccgaacaaccggtagctgtgcaaaacagtaaagcgagcatggctaagagtttgtatgtcgttttcaaattcatctgtttacattattatatatgtatacttatatatcatattccattatcggtcacacccgactcgcccgtcccctcattccagtcctccaggctgaccgagagaccggtcacctcgtcataggcaacaaccaggtcgaggatcacacgcgacgatgtcttttggcggaacacatcgcctacctcacggggaataccgatgctggtggtcagctccttgccgtcttcctttttaagggccaggtaaagatggggagcttcgctgtccgacaggccgaacagggtcagcagtgccctgtatcttccctccccgatacactccggctcaaacgccataaaagccggagtgccggacaaggcggcgcccgaagggatacataccccttgtgaaacaccgctcaagtggccgataagcccggccaaagcgatctcctcttttcctccttttgttatcttgatatacaattccagcgttctgaccagatcgaccggatacaatgtctttattgatacttcctcacccgccaccggcagcgtctcactgccacagcccagcaggtttttcggaccggtaaggaacgaagaggatgatttagatttcagtaccgatacgtgctttaccataccgttaaccttttcatagccgttatccgtttccaacaggatattatacggatcggagttgcagaccatcacacgataggtgcccgaagggagtgtcccttcaaaaccatttgcccctgcccggcggataagaggaatgccggaaccctcgcggtagaaataatagtccatacgcgatggatgtcgggctccctgccagtcgaggctcaggcgcacttttccgttctttacccagtcttcatccggtgtaccgtatgtacaggaagaaaagattaaaagacacgccatacatgccgttgctatgattgtccttgcgttcatttgttgtgtgtgtatttatctgttcatatctgctattcctctctttcagcgcatccggaaacggtaggagacgttcaactccagacccaacataaagccggtcgatgaaaaattcgtctccaggtaattcatatcttccagcttgtcgtagcggtatttcttaccaccggataccgatcggtaaccggcctgcaggttcgcaccggcggagaagccggcacccaacgacaacaggtagcccaccgaagcacccgccgaccagaaacggcccgtacgtccgtaaagcgtttccttatccgggtcgatcgcactgccccgtacgtcaaagtcgccatagccggcaaaaaagcctgcgttaaatccggtgaactcacccggaaggaaccatatacgcgattcgagagcaatctttgaaagggcccatctgtcgcgtgatttatctttataagcaaagtcggaataaaggccgccgagcgcaatcgaccagtgctcggcaaaaaagcactccaccttcatgttcggcatgaaggaaccggtctgtatcttcgtatctactacacccagaccgatggatggagccaccgtaaaccaaggtaacaagttcgtctgcaaaaaaagtagacgggagataacggagcttttgtaatagcagggacaggggtagcaggaatgggggtagattgctcgggttgtacccttttttcatctttttcacgttgtaccagatgtagtgtctctctggtcgttatcgttgtggcttcgtaaaccggggcttcctctcccctgccatctttcaccggctcatccaccacagaggccagacggtagtcttgtaactcggaacggtcgaacaacaggtcgttgatacgatagacctcacgatcgaaccctttcaattcgccacgacggtaaaggtctgcataagggatttcgccatatttcttcaattgtatctttattgcttccggatagcggctctcgctaaaccagatagccgtgttagcaaaccacggcaggggcccataaaccaggtagacgtgtacgccgtcacgataattgccgctacggtcgatataaaaggcgatattttcatggggaatatccagccgtgtttttatataggcacggacgcgattcgcacgaagcgaagcctcgttgatcacatccggatctgtattattataagggcccacatgagagataattaacaaatgataacgacctgacaaaacctgctcgcaacgcacacgcaacacctgcccgagtcgttccaactggtaaacattgtcgccataatcggccagaaacatgtcattattttctttaaaagagaacaataacgactcagctttaatgtatgtagcagtctgagcatgaatccctaaagagaaaaacaggaacagacaaaacagaattatcatcatcaccttattactaatacttttttgttctttcattttatccatccgattactaagtttataattcaagccatctccgaaatagtgcccttatttatgaaataagggaggtggcaataaaaaggcacttcgtaagagaatgaaattgcctcccggaagggtttatctgtagaggactgggatttttttagagagattttagggaaaacaagaggatatagttattgttttttccaaatgaactttaaagggatgacagttccggcctcctttatgcctgtgttcaattaacttcagtttacagggaaataaagcaagcaaatatgtaaaaagtatttaaaaagatgcttatttttaataaacagccctatgcggtttgtttttttaagataaatctatctatatttgcacagtttcctgtcacaaataactcttcggagggctcgtaaagccttatatttgaaataaaggaagcacctcccttatttcataaatcaggaatcgcccgcttacggctcttttcgcgtctcagccgaagaccggcaaaaggtgacacctggggcttcttcttccagccgagacaggcacggttatacatcgcacgcaggttactcatgtaactgttcacgctatttacccgtagctctttacttcgcagccacttgataaaaccatatactacttccggagtcatatcggcgagagagaactcccttccccgattgtagttgttaaaatgattacggacggctcggtacaaatcggccgtactttcatcgcccgaggaacgtttctcttgttcctgcaagcacatgtgtctaagaaaatctttgtgtttcattatttcctcttttttaagaaggacaaaggtacaacaatccggacacaccgtgtttttactttctaaatgtcaggattttgcccttttctttaacaagcaaaccgacgatttattggtttccggataaaagaaggggtttcgggaacgttttcaagaggatcgtccagaatcacctggatgattttcggattcttccttatattttccgaaaaacatccgatcgatttgatcgagctatgcggataaatttatgagatcatccggatgattttttttacagaaggaaaatggacggaaaaaaggcacaaacagccctttaagagtaaagaaaaagcgctttttttcttctggaaggggtaaaaacagagtcacattcaaaagaacaaaatgtctgtctatcctgctattcgccaacagacaaagagaactccattcgtatggtcgttgattttcacgaaaaaagcgacaaagaaaattgacgaacccaagcaatatgtaaatccttaacttctccagaatagaatatcagaaatgaaatccctataacctatcatacaggcgatagattacctaggtaaaatgacattttgttacacagttccagatctcggacaaatgttaaatcgaaaaagggagggtagaaattctaccctccctctttgaaattaataattgtaatccaaacgagccttcaaggtcgtattgggtttattacaatgtacatccaccgttattttagtagaatgccagaaactagttttcaatttacaagagacagattgaccggtagagacattataccattcaccgccacctccatcacttgagtgaaccacaagattaaacatagctccggaaggttccaatatagttgcagtagcagaaatcgttactccccaacctcttttactaatttcataatgaccgtttccatttccgtccagtctcagttcaaacggaatagtaccaccaccatttactgcttgttcaacagtggcttcacttacactattttctgccaattgattttccagagacttttgaatctgtgaaaaaattacatcaaaattcttttccattgtaataaatttaatttgttaataaatagaattatttaagaatgttattggattcacttctgtaatcgttttcaattcatctggatcgaacaaatcactaaaattatcccaataacatttcatatcgtcgataaataatatattcaggtaataatcactaccatataggaaacgggattttactgtttcgggagcatcctgataataacgatgcatcatctctaattcactttttacggatatacaggataaatcggtatacagattgggataaatatccatcattcgccgaatacaatccgtccactccgtctgcttacctgcatcctgagcaccaaaatgagccagatttaatttcaaggcaggatattgttgcaaaagttgttcccatattttcggatgattaagtattcttacccgctcttcaacccgcttcatatcgataaggccgttatgttcgaacttatatattcctttcttctctacaactttcccgttttcataaatagcccctcttacatctatcgaaggagcaaatgaggcaaaaccactcgccgaacaatgtgcagtaattggaatttgataagattgacaatattcataaagaggcaacaaccgttcatccgatggagaatatccattaggtgtatacaacttaataccagaaaacaaacctccattcaaacgtaaacgtgatataattttattaattccaagctgcttttccggattatcaaacaattccttacgacggggatcaatggcaaagaaggggtatatacgatccggatatttcattaccagatcacacaattgctgttcttgttttgcaaaatgatcatatgcttgtaattcttgcatatcttccttattcagcaattccgataattcacgaaaatcgtccaatgaatcttgattttctaacaaaagcaatcgaacttcttccagcacttgttgtctggattggattatattacaatcattaccaaccccagagactatcatacatccttccaaatcaaacatcaacggacaaaaagcaaatcctgattcatccttttctaacgattggtatattttttcaacaggtagcatacctgtcttaaagaaatgaagagctcgcttgagtggagaaatcacagagtttagaccctggttatctctttgtccccttaacttcaaaagcattcctaactcaattaataaacgaagggataatatctctttgttaaaaaagtggcaatggacatctatcggaccaagttgttttaaaggtttcataagctatttaattattagatttaacttattcgtaaatcacattgcaaataaacactaaataccaatacaatcaaaagatacaatgagttttaaagtgacaacagacgcgttgtcatatgacaataatagatgtcacctgataacagtacaccatctatcggatttgagtttatgagaaaaaatcataatcgctcaaaacccttctgaacaagtgcctccagtaaattacgtttgaaacaaatctccatcttaacagaaatgtaacatctatttcattcatccgaaacaacaatagcgttcctttgcgggaaaataattaaatttgtaaacaatgaaatgagtttttcatttcaattaaatagaaaagactatggacatgccccgaattcttgttgtggacgacgaagaggacttgtgcgaaatcctcaaattcaatctggaaatagaaggatatgaagtagataccgctttcagtgcggaagaagcactcaaaaaagacctatccgtatatcagctactactgctcgatgtgatgatgggagaaatctccggattcaaaatggcaagcatcttacgaaaagatgaaaatacagccaatgttccaatcatcttcttgacagcgaaagatacggaaaacgatatgctgaccggttttaacctgggagcagacgactatatttcaaaaccgttttctatccgccaggttgtcgcacgtgttaaagcggtgttgcgcagaacagcagagaaagataaaactacggctaacgagttgctcgaatacgagacactggccctcgataccaaacgtatcaaagcatccgttgacgggaaagaaatccctctgaccaaaaaggagtttgaaatattaaaactgttactggaaaacagagggaatgtattttcacgcgaagagatcctgtcacgcatctggaaagatgaagtatatgtattggaccgtaccatcgatgtaaacatcacccggctacggaaaaagatcggcccttacggaaagaatatcgtgacccgtctaggcttcggttattgttttgaatgctaatacccgttatttgaattatggtaaaagtagataatatgaagagcagaataccgttcagccaacggttgttctggtctattttcgtgatgtttttgggattcaccgtctgtttcctgttatttcagtatcaacgggaacgtgaattctcgcaggagaagttgaataatgtattaagcaactacaattaccagctattccggcgtacacagcaggttgccgatatggataaaaacgtaaaacaattcatagaagatattccgcagaaggacctgcgtgtgacgattatcaaccccgaagggaaagttttatttgacaacagcggaactgaagagttcaacaaccataacgaccgcagcgaagtacgtaaagcccgtctatataatgaagggtttgctatccgcacatccggctcaaacggaagaagatacttttattcggccagcaatataggcggctatatttaccgctctgcattgccttacgacccgtatgtgcaaaatgcactgtcgaccgataaggacttcatctatttcatgatactgatgaccctgatcttcttcttcgtactctcccgctttacttttagcatcggccgtacgatatccaaacttcgggactttgccttgaatatagaaaaagacagaataccggaaaccgattacatgttcccgaatgatgaactgggcgatatatccagaaatatcatcacgctataccaccgtcagcaaaaagcaaaagatgagctttccatggaacgggagaagctgattaaacattttcagtacgcaaaagaaggatttgccatgttcacggcagaagggaaagagatcctttcaaatattcttttcatccagttctcaaacgtgctttccgacagccagatccgtcaggcagaagaagtgatagacattcaggagttagaacctatcaaaacattcctgagcaaaaatatacccaatacaaaccgtaagcggaaagtattacgcgaatctgccacaatcgataaaaatggcaagatattcctgatcgaatgtatcctgttcctggataacagttatgaaatatcgatcaacgatatatcccgtcaggaggaagaaagcaggatgaaacgccagcttacacaaaatgtagcccatgagctgaaaacccctgtcagcagtatacagggatatctcgaaaccatcatcagtaatccggaattggcagacgataaacggcagtttttccttgagcgctgttactcacaaagtacccgcctgaccggattattgcgcgatatatccgtattgaaccgcttggatgaggcctcagacctgttcgacttggctgacactaatatttcaaaactgatcagtgaaatacaaaaggaatgttcgaaagagatggaagagaaacagatcacttccgaaatcatcctgccgggtgatccgaccattcatggtaattactcgttactgtattccatcttccgtaacttatatgataatgcgattgcgtatgcaggagaaggatgcaagatcacgataaactgttataaagaagatcctaaattctattatttcagctttgccgacaacggtaccggcattccggaagagcatatcaatcgtatttttgagcgcttctaccgtgtagacaaaggacgaagccgcaaagtaggtggaacaggtctgggattatcgatcgtgaagaatggtgtcaacttccacaagggccagatttcagcgaaaagtagtccggggaaaggagtcactttcttcttcacgcttaaaaagaagttgtaaaccattccttaaattcggaaacacgcactttactgaccagtatcttttcttccaccggaaccttcagattgactgataagcgtccgttgaaccaaagatcgatatccaagactgctttccgggatataagatactggcggtttatgcgaaaaaacaagtccgggttgagataatccgataattcatccaaagtctgtgtaaaagtatattccttaccgcctgtcacaactgctttcacattcccttcatggatatagaagaataagatcatatcaacggacagaggaagaagcttatctcccttcacaggaacgagaaaatgcgttttatacttatcctgccgttttaatatattgataagattactataatccggctcttttacaacgggatccgattttaattgtttcagtttccctatcgacttccggatatcactttgcccgataggcttcaacaaataatcaatactgtttactttgaaagcacgtaaggcatattcatcataagctgttgtgaaaataaccggacatgttatgtctacatgttcaaatatttcgaaagaagagccgtcggccaggtgaatatccagaaatatcaattccggcattcggttgtcactgaaccaatccaggctctcggctatactatcgagcacggctataacctctatatcaggcgcttcctctgcaagcaaagccttcaggttacgaaccgccgctttttcgtcttcaataatcaatgctttcatatcaatggaatagttacaagaaaggtattattatctttacgcacttcgatctcttccttaaataataagtgataacgttttgccaggttcgacaaaccgatacgcatgccaccgctggccgtgagcttgggttgaaccggattactgaccgtaagctgctttccctccgtataaatccggataatcagcggatgacgattactgatctcattatgtttaaccgcattctctatcagcaactgaacggacataggcggaagttgataaagaccggcctcttcggctatccggatattaaaagacagattttcttcatagcgcattttcaacaggaacatataagcatgtacaaactccatctcctcttgcaaagtaacactctggcactcattctcctgcaacgtataacgaagcacacgggaaagctcctgcagataatcctgtgccttgtccggcatctcacggatcaacgaccgcaatgtattcaacgaattgaacagcatatgaggattcagttgattctttaatgcctcatattgattgatcaggttctccgtccgcagttgctggttctctatcgaaacctgctggcttttacggatcaggtggatcatataacaactccctgtcactatgcaggtaatgataaagtcgcgcaacggatgcaggtaatggtgcaccatcgcatcgatggccggaatatcgaaatggtgatggagataaacaaagccctgccccaacaggttgctcatcgtccaggtcatgacaaaggagagtatcattttcccccacgtaatacgcgccgtcggccggttaaaaccgaataacaacgtattaagagcaaacaggataagcaacgagacaaatgtaaaaaaaatttcattggcaacatcagctatccgcattcccggaaagagattatcctgtccggaatggtcgaagagggagatcagttcgggaaaatgagtcaggaacgctatcaccaccgagatgacaacgactgccaatacatatttgtctatatttatcttcattgtgcaaagatacttatttcttttctacacgcgctgttacatacatgccgggacggaaacgttcgttatttctttttacccgtgcatagatttccagagaacggtttacatcatccacctcctgcccgatagagagcagtgttgcttcgaaggtttgctttcccattccattcacacgaaattgtatacggcttccgggggtcaggtcatccagatccttttcgtaagcggtaaggcacaacaggttttccgccttatcgatcacctcgcacatggattcaccggcttccacatatttacccagattgatcgtcattccggtcacgtaaccgttcaggggtgatttcacttccaaaaaaggacggataccgcttttcaataaatcggcaggagaaacgcccaggagagtcagtcgggccgcagccgcttcgagacggcttttcatagacagataatctgccttgctctgttgaaaacgcttttgagaagcagcttcctgttcactcaaacgttcctgccgatggtattcagcctccaggtactccgtttgtgcatgggcatccaggtaggtctgttgaagggttatgaaatccggattctccaaagtggccaaaacagttccttttgtcacataatcgcccggaagcagagaggtcgtgtgtacggttcctcccatagtaagcgtaactgttgcacgacgctggggaggtacgatcatttttccgttaaaagaggaatgattcggcatagccgttgcagatgtgacggcatctatcggaagggtatcgcgggtaataaccgcgggttcgacttccggggttgttacggtggcctcccgaggttgttctttctctgtagtcgtgttgcaggcgccaaataacaggattgctgctatgggaataaatattcttttcattgtctatctttattataaattatttctagtttaccttgccggaactcccaacgatcgtttttgcttactgtgtgtacagttccagttccaatacggagatattgtaattatatgcagcttcaatatagcctttccggatctccctgacactgttcaggctctgaacgaactgcataatgtccgtttcgctttcgcggaactgtatctgtgcactgttcagcaatgcatcggcttccggtaaagctccggtggtataataacgaatgctttctccttgctggcggagcatcgcctgtaattcctccaccttattacccagctgccgcctgttcgcttccgcttccgtccgggctatgccggcatctatcctggcttgctttgtacggctttgctgtggaaagaaaagaacaggaaaggatataccgaccatccatgagttcaacccgttaagcggcgttatcttctgacggatataacctaccgacaactcgggaaagaaacggctacgttcgactctgagtacagctttcttttcatccgccagactttgaaaataccccaaatgcacatccgacaaggaaacagatccggtttccaccgggaataaaaccagtgtgctatcggccgggacaaccggcccgtcggaataacaggcccaggaaaaacgacgggcagccagttgcaactcttcttccgactgcatcaaacgtgtacgcaaatcggcagccaaagtcgttgccatattgcgttccagcagagtgatgtccccctgctcatagcgcagttgtccggcctgctgcaaacgaacagccagttcattctgttcgccgtaaagagaatggagattggctgcatactgataataggcccaggcccgctttacttcggcaataatttctttttttaccaggtcacgataatattcgccggtcgcgatccgcttattgacaagtgtatttttatagaatggcgtcaataaggaacccagcgactgagtaacctctatctggttatcgttgcgtgtttcgccattgatctgtccccacgaatagctaaccgacatgggagccggttcccatgattcgccacgggaagcacgcgagcgatcgattgccgcagatgccgttttcagacgcggatggttttgcatggcaatggataaagcctcctccagtgagataccccttgccggagcctcccggttagttatattcccttcgccccaggccggagatgccaggcaaacaaacagtaaaacgaccggaagcaccttacctcctctccttctccatccctttttccatacgtacgggaataaactcaccatccggtaaaacaccggtattattaataaggtaaggatcgtagagacaatcaaccctccaatcacgacggttgccaacggacgttgcacttctgctccggccgaccgggctattgccatcggaacaaatccgagcgaagcaaccaatccggtcagaaagacaggacgcagcaggtgaggacaccctttcactataatacggttcgtacacatatgatatttcttttgtttgcgcaactcattaaaatgattgatcatcaggattccgttcagtactgccacaccgaacaaggctataaatcccacaccggccgaaatgctgaacggcaaaccacgtaaccaaagtgccacgatccccccgatgagggataaaggaacggtagagaataccaccaacgtatacgtcacgctcttaaaggcaaaaaacaacaataggagaatcaaggccaatgcgaccggaataacgatcagcaatgtatcgatcgcattctgcaaattctcgaactgcccaccatactcaaagtaatatccgggcttcagtttaatatttttatccaaagcacgctgaatatcggaaacaacctgctgaatatccgcatcacgtacattgacaccaatcacgatacgacgtttggtggcatcacggtttatctgaagcggaccgtttaccagctcgatattcgccacttcactgaccgggatctgaataccctctgccgtacggataaacagtttatccagattcagatccgacactttatcgttatccagccggagaaccagatcgaaacgacgttcattctcgaaaatcacaccggccgcttcacctgcataagccgtgcggataattgtattcagttcttctatattcatcccgtaacgggctattttggcacggtcgtactttatgaccagttgcggcaaccccatggcctgttctacgatcacgtcggcagcaccgggtactttcccgacatattcagccgcttcttttgctttatcatacaattccgccatatcttcgccatacagcttgatggcaatatcagccttagctcccgtcatcagttcattgaagcgcaactggatcggctggctgaaattaaattcggcacctttgaccgaatcgagggctgttttcatcttttcaaccatctccgcacgactggatgctgaggtccattctttaaacggtttcatgataatcattatatcggcatcttccaccgccatcgggtcggtcggaacttctgccgttccgatcttggccacgacatgtttgatctccgggaaccgctccatcaatattttctgtgcctgcccggagagttcgacactccgtgtcagcgaacttcccgccggaagagtcatctgcatggcaaaatcaccttcatccaatgtcgggataaactctgcccccaaccgtgtaaacaagaataaagaggcagccagtaaagcaaaggccgaacaaacggttgcccgcatatgatgcaaacaaaattgcaagcaacgcttatacaccatattcagcttctcaaaaaaacgatcggcaaacgtcggtttggatgaaatagtccgctttaagaatagagaagccatcatcggcacataggtgagcgaaagaatcaatgctccgataatacaaaaaacgagcgtcttagccatcggagtaaagtatttgccttcgatccccgtcagggtaagaatcgggaaaaagacgatcaggataatcaaaacggcaaaagtagcacttcgtaccacaccgcttgccccggcttcaacttccttatccatctcggctccggtgagtgtccggccggcaagcctcctggtataaatatgagccaggactccttccacaatgacaatcgaaccatccacaacgataccgaagtctatggcccccagactcatcagattggcagacacaccgaatatccgcatcataataaaaccaaacaacatggctaacggaataacggaagcgacaattaaaccggcacggatattccccagaaagatgatcaggacaaagaatacgattaaagcgccttcaatcaggttacgcacaaccgtcgatatattccggttaaccagttccgaacggttcaggtaaggttctacactaagaccttcgggaagcattttctgtaccttatcgacacgtttttccagttctttcgtaactacatttgcgttagctcctttaagcatcatggcaataccgccgacacattcaccttccccgtctttcgtcatagcaccaaaacgtttcggagctccaaagcgaactgtaccgacatcgctgatatgaacaggtatccctccccgattggttataacaatacgttcgatatctttcgtactgcttatcataccctcggaacggatataataagcccggttcaccttttcaatataaccgccgcctgtattctggttgttactgctgagagcggaataaacatcgccaatcgtaatattcaatgagtataaagcatccggatcgactgccacttcatattgtttcagataaccgccgaaactattgatctctacaattcccggaataccggaaagttgccgtttaacgatccaatcctggatggtacgcagttccatggcatcatatttatcttcatagccgggagccactttcaatacatactggtaaatttcccctagtcccgtagtaatcggcatcaattccggcgttcccagttcggaagggatctcaccggatacagtttgtatttgttcattgatcaactgacgggcatccaatgtgggaacactctctttaaacaccactgttactagcgacaatccgaaacgggagacagaacgtatctcttctacattcataatattgctcatagcaatttctatcggaaaagtaatcagctgttctacttcctgcggagccagggtgggcgaaaccgtaacaatctgtacctgattattggttatgtcgggcacggcgtcgatagggagcgtcaacatggcataaataccgccaatcaacagaaataaggtagtaagtccgacaaacagctttttgcggatagagaaatgtacaatagctttaaacatcactttgtaatttaagataatattacaaagttaatgagcctcctattgaatagatataagaaaatagcgaagctgacagaaagggaagtgaaatatacctatcagcatttaaaaggaaaggaaaaataaattccggaaaaggtcaggacaatgaactttttgaaaagggatacatgcgtatgtaaaggggtacatgcatttagtaagggtctgcattcacgtgcgtgacctttcccggaattaaatcttatacgacttcgtctttttcattaaagtcgtctgcttcctgattaccaccttcgatggtctctgttacatctttaacatccccggaagtatacgtatttcccaacatagagttgtcggtagacatcgcttcatctgttagttctgaactctcgtcccacaatgttttcattatctttgtcataaccattgattttaattagttaatacaataaataaacaaaacaggaaaaggaattgttgccggaattatcaaaaactacaacgtagtatacagaatcgaatctaccgcatgcgataagatatatgcagccggggttgcattcgcctgcgaataaccctgttgcaactcttctattgcagcctccttacctgcacccaaaacaggtacaagcaacggggaaccattcaatatgatcggaccggtcattgtaatacggaactgtccggtttcaggatgctgggagacggcatagtttcggctatccgtcagcaacggaaggttatcagggaaaatagaagctgtatgtgaatcgcctcctattcccaaaatgatacaatcgaaataagggaactgcccgtgacggggtaaatattcctttacgatacgcgaatagcgcatagcctccgtaccgggttccacctcgccatgaatgcgatggatgtgatccctggggatttgcaaaggttcaaacagtaacctgttcgcatgtccgaagttactatccggatcagtcggggcgacacaacgttcatccacccagaagaaacgcagattatcccaatcaaccttatccttgtattcatcagcccagagggcaaacatcttctttgccgtttccccgcccgaaagagcgaggttaaacggtttctgatcttctttacgggccatataatccatcaattggctggtcaaagccctaagagcgtctttactatctttataattttcaactttcatacgtaatattcatttttattaatcagccgcaggaatcgcagggagcccccatggagtctgcgcctaacatcattctttctatcggtccgttctgtcccggttcatagaaaaacaatcgcttcgccccttcttctttccaatgatgcaggatcgggtcgataaaacgccaactagcctccaaagcatcgctacgtgcatacaaggtagaatctcccagcatagcatctaataacaaacgctcataggcatccggcaaatgagtctttgacaatgaatcgtaacggaactccattccgacttgctttaccgtaaatccggcaccaggcatcttcagtccgaaacgtaacgtgatgctttcgtcgggctggatacggatcaccagcttattacaggaactacccgaacattgtccggcaaacaactggtgcggagtcgatttgaaatggataacgatctccgacgacttctccggtaacttcttcccggtaaagaaatagaacggcacaccgctccaccgccagttatcgataaaaaacttcataccgacatacgtctccgtattcgaatcgggagctacgttcttttcttcccgatatccctcgtactgtccccgtaccacccattcgtttatctcacggatcgtataagggcggatcgaacggaaaaccttcacgatctcgtcgcgaatcgactccggatcgaataccgaaggcgactccattgccgcaaaggccatcaattgcatcagatggttctgtatcatgtcgcgcaaggcaccggcaccatcataatacttaccccggttctccacacccagcgtttctgaggcactgatctcgatcgagtcgacatagttccggttccacagcggttcgaatataccgttcgagaaacgaagtaccagaatgttctgcaccgtctcttttcccagataatggtcgatccggtaaatctccttctcatcgaaaatacgacacagatgctgattcagttgctgtgctgtatccaggctcgtaccgaaaggcttctccacaattacgcggcgccagccgtcttccgaagcggcaacattcataccgttctcctgaagatacttcggaaccagttcatacatcagcggcggcgtggcaaggtaatagatcaccttgtcgggaaggtgttcctcctgctgcaaaagatggatacggtctttcagtttcacatattcggcggtattggtcgaatcgaatgccaggtagaaaagtatctgaagaaatttatccagatcttcgctgtttgtttccttatttccccgtgcttccaggatatgtttacgttgttcggcacggaattcttcatccgtaaatgtggtgcgcgcagcacccagtatcgcaaaatgttctggtaacatattgctgacgtgcaattcaaaaagtgcaggaagcaacttgcggcctgtcaggtcgcccgatgctccgaaaataacaagtaactgatcatttggtctgttcatcctcacatcctccaccgggttaagcattataagttccggaaacggtatttccaccttcacccgtccagttggtatgaaagaagaggccacgttcacggtcggttctttcataggtatgggctccgaagtaatcacgctgtgcctggatcaggttggcagccgagtacatggtacgtaatccgtcgaaataactcaaagcagaactcatagccggcagggccactccacttaaggctccttcggcaacgactttacgccaggaaggtaaggctttctgtatctttgtacggaagaagtcgtcgaacaacagattctccaacttcgggttcttgcggtaagcttccgttatcttctgcaggaagacggaacggatgatacatcccttgcgccagatctgtgcaatagttccgtaatccagatcccaatcataatgctcggaagcacggcgtatcaaagagaatccctgggcatacgagatcaatttggaagcatacaaggcctgacgtatctcttcaacgaacaggttctctcccaactcgacaggttcgggatacaaaccggaagctttttcgcgctcgacataaagagccgataacagacgggcatatacggcttcagtgatcaaagtcagtggatcgctctcatccatagcagcgatagcactccactttcctgtccccttttgtccggccacatccagtattttatccagcaacggcttgccgtcttcatcacggaaacgaaggatattcttcgtgatctcgatcaggaagctgtccagttcccctttattccattcttcgaatacgaccgacatttcatcgttgtcgagtcccttccggtttttcaacaatgagtacgcttcagagatcaattgcatatccccatattcgataccgttatggaccattttcacaaaatgtccggctccaccgcgtccgatccactggcagcagggagtaccgtcatccagcttggctgcaataccttgcaggatatcctttacaatcggccatgcttcgggagaacctccgggcattacagaaggaccgtgcagtgccccttcttctccgccggaaatacccgaacctataaaatacaggcctttcgcttccacttccttcacgcggcgttccgtatcgtgaaagtctgagttacctccgtcgatgattacatcgcccggcgacatatgaggcaatagttgttcaatcatttcgtcgaccggcgcaccggccttgatcatcatcataatgatgcgcggacgctttacagcctccgtcagttcttcaatcgaatgggtggctataaaattcttgcctttaccacggccattcacaaaacgatccactactccttcttcaccgggaaagttacgattatatacagcaacggtaaaacctttgctttccatattcagagccaggttctcccccattacggcgagaccgatcagtccgatatctgcttttttcatgttcttttctattttatatttcgttttcactattttatcaatgcgaacaaatcgttcagcgattcgctcatcgacgggtgtgtataaatactatcccgcaaaaatgtataatcctttccggcacgtatggcaagcgatacagtgttgatcacctctgtcgactcggcacagaaaagtgtacatcccattatctctcctgtttccgtatcgacgatcgctttcaataggccgtccgtctgttcgaaagtacgtgtccgtgggaatgcagcagccggaatccgcgcaatgcttattttccttccggagcgtagcgcctcttcctctcccatcccgatgcgcgacaacgggggatcgataaataccgagtaggcaaccgccacacggtcatccttcgtgcgctgcccgttgccgaacaactggtcttttatcacgcgataatcgtccagagaaatataggtaaattgaagaccaccggtcacatcgcccattgcccatatattcgggacattggtgcgcagatggtcgtccacaataacggctccccgatcggagatctctatccccgcagcttccggatgcaggtctgtggtgttcggacggcgtccggttgccagcaatacagcgtcggcaggaagttgtacttcgttttcttctttctctttatatgttataacagctccggtgtcattgtgttcaatcgactgtaccaaagcattcaaatggatagtgattcctttcttttcgagtaccgtttttaccgcatcggcaatgtcgcggtcctcacgggcaataaacttgtctcccccttccaatacgatcacttccgaaccgaaaccggcaaacatagatgcaaattccaggccgatataaccgcctccgacaatcaccagccgacggggtagcttatctaattccatgatcgaggtgctggtatagacaaacggatttccttctatacctttgatgggcgggatgatagtagatgctcccgtattgataaatatctttttgccttccaggaggagggtttcgttgcctgcttttacttctatttcatgagaggaacggaaagaggcgacgcctgtatagacagtcacagtgtctttcgaatcgagattgtcaaaattctttttacgcagcaaagaggtaagttcccttttcccggcaatcgcctggcggaactcttcggtatattgttcgaaggaagaaggtttacggtaggatatgactttcgacatatgcaccagtctttttgtcgggatacaaccgatgttgatacaggttcctccgtacattccggacgaacgctcgataatagcgacattccagcctctgtttcccaactctgcggcaagtgttttaccggctttaccaaacccaatgataattgcatcgtactttttcatccaacaatcctcctctttttttagactaagctataaacagaacagctgttttaacctaattgttcgtaaaattttatctatattctgataatagttatctatcactctgccctaatagcaaaggctgatggtacaaaagtaaagaatgcagacggttaaggggatgttcatttttcctgaaaagttggcgatttggctattctttgatgatcttattcttcttccggtattctgtcgtactcattcccgtcgtatttttgaagaagcggctgaaagttgcctggtcttcgaaccctaacgacagagcgatctctttggaacttttggaggtgtaaagcaataagcgttccgcttcggcctgtatccggttatggataatgcggatagccgaaggttgttggtaagtagccagcaggttggctaatgttttgggagatttattcagcatatcggcatattcctgtacttgtttcttttccttgaaccaggtgtcgaccaatacatagaacttacggatcgtctcgaactgcaccccgttctcttgtctcaccccatgccgattttccgccacacgcgtacataatataataaatcgtttcagcaaaacacgaagcatctcgtcctgcaaatggtcacgactctcgaattcctcgcacataatacccgtcaacgtatcgatcttgcgccgctcttcgtcagacaggtcaaaaatcacaacatgcgaagagccgtgaaacaacaagccgttacacgagacctcatgatcattaccatagatacagtagaaattactattgaacatcaatgccagataggttccgtccacccggataaaatccagatgatgcaggtgagacaaagtaagcaactgccccgcatccaatacgacagtctgatgatcgacatccagttcaagccgaccggaaacaacccaaataaacttatacaatgttttgtctttcaataaagccgggttagtatccagcgaatccgataaaataacttttcctttgatcttactgttttcaaatgataaattcatggtattcctgtacgttatatattattacctccattcggtagggatctcccccgtattcctgcggaaccaacgggaaaaagtatcgtggttggcaaaccccagcatcgtagcaatctgcgaaggacgcaggcgggttttcgacaacaagtcttttgcttccagcaatacgaactcactgatccattcggcagccgatattcccgcaccttgcttacaccggatattcagttcctgcgaagtgatccctaacttttctgcgtaaaagtacgcaggagaatgatgatatcggctaattaaggtcgcaaattgttgaaaaaagagtgaattttctgttttgggcacttccgagaccgattttccctgttgcagatttatgatcaaagctcggagcagcgactccaccactttggcacgcatctccttcatctgctcgacctgcgattcgatcagcctcagataagttcttgtttcttcaatctcgtcagaagggatatcgcggtaaacaagacgttgccggttaataagtaactcttcggatacataaacgattataccggtaaacccggtagactggaaagattttatttctgttacatcatcactggcaaccaatagaagctgccctgcagttacatcataaacctgatgcatagcctggcagctgaaagttcccccggtacagatcacggccaatgtacccgagtccaacggaagcagcttacagttttcaccatcttttacatataggatcttcagcgaactttcaagcgttagctcaggtgtcgacaccgtattgtaaagatcaacgggtaatattctttctgttttcattttttaattactatttttagcgtataaattaagtatcgggtaaacatacaaacgtcattattagtttattatacagtaggattttatctttagttaaaaccatcttaagaacattttatgataacaactcttattattctggctctttcggccttctttttcgtaaacgggaagatccgttcagaccttgttgctctttgtgcgctggtcctattaatggtattcaacattctgactccggaagaagcgctctccggtttctccaattccgttgtcattatgatggtcggattgttcgtagtaggtggagccatcttcaagacaggactggccaagatgatcggtagtaaaatactccatctggcaggaaccagcgagatcaaactatttatactgattatgctggttacagcttttatcggtgcatttgtcagcaacaccgggactgtagccctgatgttgccgatcgttgtcagtatggcggtcaatgccaatatcaatcccggccgtttccttatgccccttgcgtttgccagcagtatgggaggtatggccacgctgatcggtacgcctccgaaccttgtggtacaagaagcattgtcgaatgcaggctataacgatctttcattcttttcgtttaccccgataggtatcgtctgtattacagtcggtatcatcgtcctgatcccactgagcaaatggttcctggtgaagaaagaagataacaaaaaaaacgatgtaaccaccggccgttccccgcaggagttggctaccaaatatagcctttccgacaacctataccggattcgggtacataaagactcacggatacgtaacaagaaattgcaggaactcaacatcacgagcctctacaatcttactattctggagatcagacgcaaatcctcttcgcaaagccgtttcatgaaaacggtcgatcagaaactggcaggccccgatacggaaatccatgaagaagatatcctatacgtattcggcgacttcgataatatcgacaggtttgtcaaagagaaccacctggatctcaccgagtcgcaggtttccgaatttacaggcgaccaggaaaaactgagtgtccgcgagatcggtatcgccgaagttctcttgatgcccgactccaaactgatcaaccgagccgtcaaagactccggtttccgtgataaatattcagtcaacatattagggatagaacgtaaaaacgaatatatcctgtccgatgtaaaagatgtaaagatgcatgccggagatattctcctgatacaaggtaactgggacgatatcgcccgtatgagtaagaaacagtcacaatgggtggtactcggacaacctgtcgaagaagcctccaaagttactctcgactacaaagcgcccgtagccgccggtatcatggccctgatgatcgcagctatggtgttcgactttatccccattcctcccgtagctgccgtacttattgccgccatcctgatggtattgacaggctgtttccgaaatgtggaagatgcctacaaaacgatcaactgggaaagtatcgtactgatcgcagccatgctgccgatgtcgctcgcgttggaaaagaccggcgcctcctcgctcatctctgaaaagttggtaggaggactgggcaattacgggccgcttgtcttaatggcaggaatctatttcacaacctcactgttaaccatgttcatcagcaacacggcaacagctgtccttgtcgccccgatcgccctgcaatcggccattgccataggtgtaagcccctacccgttcctgctggctgtaacagtcggagccagtatgtgttttgcttctccattctccactccgccgaacgcacttgtgatgtcggccggtaaatatacgtttatggattatgtaaaagtagggcttcccctgcagctcatcatgggagtaattatggtctttatactgccattattatttccgttctaaacattcgtgcatcctttttagttttatatttgcacgacaaaaagaaaaacgatgaagattccttttaaaccaattactatagaggataaggagacaattacctcctttacctatcctcacaattatcgcaattgcgattactcgttcgccaacatttgcagttggcgtttcctatacgacacggagttcgccgtagtcgacggatttttgctgatccgcttcctgatagaagataaaagcaggatggtctacatgaccccggcaggagaaggcgacctgcggcatgcgttggaactgttggaggccgattcgcaggaacacggccatccgctatgtatgctgggggtgacgcccgatgccaaagagatgcttgaaaaggcattaccgggaggattcttttatattgctgaacgggattatttcgactatatctacctgcgtgaagacctggcactattaaaaggcaagaagttccagtccaaacgcaaccatatcaacaatttcaagaagagatacgagtacgaatattctcctatcactccggaactgatttcccagtgcctgaagctggaatgtacctggtataaagccaaccgtacggaagacgatgcggaagatctgaattacgaacgtatttccatgacctatgccctcaatcatttcgacgaactcggactgttaggcggtgccctgctcgtcgacggaaaagtaatagcctttacattcggagcaccgatcaaccacgatactttcggggtacatgtggaaaaggccgatgtaaactacgaaggggcctatacggttatcaaccaggaattcgcttcccggttgccggaacagttcacctatgtcaaccgggaagaagacctgggtatccccggactacgcaaagcaaaactttcctataacccggtcatactattagagaagaatgccgcgataaagaaaacgcaaaacaataaaaaagatgaacaagcaacaagtaatcgatctgtggcgtctctcgtttaatgatacggaagaatttatacgcctttatttcgaccgggtatataaagaagaaaataccctggtgatagaaaaggacggtcaggtggtgtctgccctgcagatgctgccctacaccatgacatactatggaacggaaatatccgtagcttatatttcgggagcctgcaccctcccctctatgcgcggaaaaggcctgatgagacaactcatacaaaacgcattcgaggaaatgaaataccggtcggtagccgtaacggcactgatccccgccgatccctggttattcgattattaccgggaacaaggttatacggaggtattcgactactctgaagagacatatatccgccctgcagaaccggtatgggcaccgaagctgacggttgttccgcccgaagttccttcgatagaccttctttataaatacttcgaccgccaaatacgcaaacgtccctgttgcatattgcacacaaaggatgactttatcactatcctgcgcgacctgcaactatccggcggacaaatgcttaccgcgctcgacgaacaggaacagcctgtcggaatggctttcgtacttcctcccgaccatgcctccggaataccggaagcaagcgaacaactctatataaaggaattcttttacgacgacgaccgggttgccaacctcctgcttcaggaagctaccttgcaaaacaacgtaaagaaagccgtctataagacaccacccgtagttcccggaacacacccgatgggtatggcccgcgtaatcgatacggaacggctgatgcatcactggctgtccacccataaggatgcgccggtatctgaaaagttattgaaagagcaggatatccaaactttcacacgaatagtgatgggatactctcagcgggaagcctatatgagcctgatgctggattaatccggcaccaggctcatataaaccacctcccgtgtcagcacgagaggttcttcttcttttccaacgcttccttataaagcttttcctgcaataccgcatattgcgcaatatactcctcttccatcattccttccggttcactggctccgtcggtttccacaaacagactgatccttttactcatctcgatatattcatcgagcccttcactggaagaattcaatacactaataatagtcttgtatctgggagtatccatactgtataaatttacatgattaaaatttcgttatccattccttacttcatccgacttcttcggaaaacaagaacctaagttctttaagcgcttctgtcgaatgaaacgaaagttggtcaaaaagcgcatgagttttaagctgttcaattgtagcatcagccgtcaatgtcccttgttcgtaaagcaacaaggtcgcatataacttatcattggcaaccggtcccatcaccatatcgaatagttccgttttattccctttccgatttccaataacaaattccagccactctaatgttgccccgttaaaacgacggatactataatccttactcagaatattatcatcaacttcataaacagaaacaacagccttagttttatcaggctcaacctcacgatttctcttaattatggcccactttctggcctgctcataactggtagtcgtataaaagccttttccaaaatcggtattctttcgtcctcgcgaaaggctcggcttcttcaccgcacttatggatccatgatataatttcattttcctgtcttttttctgttcttaatatatgtagcgacctccgatataatatattcgcgactctgtgtatgcaacatctcaaatacctgctgtaaataatcaaatacatcatattggatgaagagtgacaaagtttcttccgcagagagatgcttttcttccttatagttctcaatacagaatatctggaacaataatacagccgaatcttttgtctctcgttccctcttctctaccttttctttttccaacatatcataaagaataagcgtactcaaataccacatcttagccgaactatccatcaacttattatacagttccgtaccatataaataacataaagcatcctttagagaaaaccttttcttctccataataaaagcaacaaactgctgaagcttaaatggtaatattgcattttcaattgtagtacccataatcaatatgattaatcaatcgttatccattccgaaatattccgttcttccgcactgaaagaaacacccactttaattaagtacggttatctgccacataagggatcagatagcctttctcgagcttttcgatggccagtcctttaaacaactctttctttcccaggaaataaggtttacccatcgtcaccatttcataaaatacacaaagataacattttctttaaaaacaaccctcatttccccctccttagtttacacacaatccacagacaaaacagcaataataaggctaatccggcgagtggcaggaaagggctccggggcgaagaccgggcggtgtgttgagccgtgaggttttctgtagcaagacgttcatattccgtatgactgtctgtaacggcaagcagtgaatccgtccaggaacagatgcgggaagctttggcggtggtaacgctttgcaggtattgcacgccggaactgtccggcggcaaatatacgacctgctccaactcccacgaaaggctgtcggtgatctccaggttcgcgacacggatcaaactatcccgacggcttacctgtaccgaatccctgcgctcttccagacaggtacctgccaccgtacggcgtgctccgcatcccgccagcaaaaagataacacataacatacagagaataacctgcatacgattctttcctgaagtctttaacgagagatgaaggaacttcctgcgcttatacaggatcgcctggtcgaaaggcaagcccgactgtaacaaaagttccagcaacttcgccgggccttcgggagtataacaatcggctgcctcccccttcagatgctggctcgtagatacgccacccaccagacggtttacctcattattccgataaccgctcaaaacggcgatcggtttcttatacaactgccgcaagggttccagcaaacaaccggtcagatgttgcaacgacacccctgcttcgggagacggtgtattgtcgatcgcatgctctaccgcagtacgactataggtaagttcttccaatgtgaaatgctcactcaaccaggtctttttacttttactttccattgtcattgatttttagtttatatgtataatccaccccgaaaagagctcctgcaaacgtactgatctcaccgaaagccaccagcacactgttatcgatcagtccctgcggatcgatccagaacccgcaaaagagaaggacaatcccgctcaatgtgagcaggattgccataatcaattgaattgtcagccgtttcatcggattactcgatcaccggtctgtcatcctcgccaccgccttcaccttcattcttaccttcagaaactgtcaccttctcgaagttagtccggctcttggcgatacgcaacgccttaccggggaagaagcaaacacgcggttcgcggatcatacttacatcgaaatccttcgcatcggttactccatccgaaccaaaagagaaacggagattccccaactcccccagattgacacgccgtccgttgcgcaaatgacgtatcgataccacattcacacgatccagcaccgctttcacgctggcgctactcactcccgagccgtcggttacctcttcgatcagttcctcgaaagccaccaggtcaccgcaaaccatctgtgcatactgctttaccggatgttccgcctggtcgtcccccagattcttgcgcggaaccattttgaatttgattgccataatactaatgtgtttaatgaataataataagtccgatctcgaacacacttcaaagatagaagaccattttaccggtttcttcgctgatatggcggcagccagatggatgtactcacttaagggtataaaaaaaccctcgataccttcctgttcaggatatcgagggtttgaagaaaataatcttatacaaagcgaaccttacagcttccctatttcttcgggagtcaaaccggtagcttgcgaaatgaagggaatgtcacaacccatttttttcatatttgcaacaatctctttttgttttttgagttcgccttccacacgtccttccacacgcccttccagcttggctccgtccagtgcgtcgttttggatcatgatatcgctcaggtgttcgtcgtaggcgcggcgttcctcgtcgctcatattgtaatagagcagcttttcgcgtgcttcgctcaggccgggggcggtcgtatccggacgaatggtgccgtctttcagatattcgatccattcttcaagcggcgtaacggctacctggttgaactcgttcacacggatcaggtagtattccggaaaaatctctgccggaagtttatgcaccagggcatctttctccttgacactcacttccagacggtcgcccgtatgtacgcccgtaaagatattctgaccgtggtacaggtaatcgcttcccttaccgatatcgaaataaaggatactcacggagtagatctttttcacttcgtagtagctgctacccaaagaaatatgctccgtgatggccttggccaccccataaaggatacgttcgaggaaagtaagctcacgcgtgttctgtacttccactatgatgatttcacccttgctgtttttagccttgatgtctacccggttgaatttgtcgtcgatagcttgttgattgctctcgctctccaacaattcgatgatctccaccttttcgtccaacagcacagacaagaaaccttccagcacaccgaaattggctttttgtcgtaaaaggcgcttgatcgcccagtcgaagcggatgtaattatctttcataaggctataccattaatacgtttacattaatatatgcaaatgtaatcaatcccgggcaatatccgccaccgatagccttactatttttcttcaaaccctcgaatgcagattacgccatatcagcgcagccggattggccgtttatttaacaactattggctattgggtgccggctggccgggagaaagccggtggccctcttcgtttttcaggtcgatcaaatccactaattcgcagagggtatccgtgtcggcacactctttccggaacttatcggcaaaatattctaccgaaccctgatagtcgaaagccataaaacagcaaaaagccagatggatgtacgaagggagcttctccgattttgaatgcggcccttcaaacaggcggagcagctttcggaataataacggttcgcgcaaccgataagtcagcgtaccgagcaccgtcttcttacgcagataaacaatcgtacgttcccaatctttacgcatcaggcaaaacaggaacagatgataacggtcgtccatctgttcccagtcacaaaaggcggcatcgaaagccgccttgtagtagaactcctgttcttctgtggttaatacacttagtttcttccgaaactttctgacggaaggatgcccgcctttaaacaatactttcaaatcgttatacataaagtgccggacaacggggaatgattagccctcgctgcccggcacaaaagcccgtaggccattaatatccctgcgctatgcgaatattatgacgcgacaggcgtggattctgcggcatcgccttacgaaaccatgaaacagcttccgacggatcattctccatcaaagccagtaccccgagattgttccacgaacgaggatcatcggcaacctgctgtaaaaagtaggtcgccgcttccttatcccccaaagcaagcgaagcggcaccggcattcaacaccgcctcccggctaccgggaaaacggtaagcagccaactcatacacttcacgatactgttccgttcccggacggtataacacagccacttgcaacaattcaccgagcgtcagcctatccggatcggtaacgaccttttccgccaatgcctgcaagtcgggcgattgcacccccgtctttacagtcgtctcatacgcgatatccaactccatccgccgcagccgggaaaagaaacttttctctatatccttatatacagtccctttttcaagcgccttcaactgcttcctccggctatcggcatcggtataagtatccagaaccgacaacacctgtgtacgatagctacgacccgatttcgcgaccagttcccgcagaccttcccaatcctcgcctacccagtcgatcgtgaccggcacgccgcccgccagctccggcagtttttgcagatagtttttaaaaccaacagcccggttacccgccagccgctcattctccgccgtgctcccgtcgggcgaagcaaagcccgtcaagcgaaccgactgtatcttcttttccccatcctgcaaacgcgacaggcgttctttcagtttctccagttcagcccggttattcccatatttcaggtcgagcctgacacctccggccgggaaaccgatataagccgtcaacttttcactactcaattgttctgccggacagatttccggttccggagagagataacttatcatctccccgtaaacagcctgggcatccatcttcaatagagggatctcggtgtgacgcaccaggatcgctgccgatgaatccttctcaacaacaaccgcccgggctctttccatccgtcctgccgtcggcatctcctgccagctggtcttacaggaaggcaggacagccagcatacacaagccggccaatccttccgttactattttcttcatacattatttgctttgaggattcaaagcctccaacaaaaactttccgggtttaaactttacactggtacgggcatttatcatacaagggctacccgtacgcggattacgtcccaggcgcgctgtctgttcccaaggttcaaacgagccaaacccctgaagcacgatggcatcctgtttcaatgtctctgcaagtacctcctgaaaggcattgacgaactgcctggattgatactggggaatacgcattttcgttgctaattcgtttactaaatctgttttgttcataatcagttgtctttaaatgttatgttattttccaattgtttcttcaacgacgacaggaagatcatacactctatcggggtcacccctgcgatgtcatacagacgcagccgttccaacaccagtgcaccggcatccggttctttcctgacaaggacagattcctgcaatgcttcctttttcaacgcctgcatcgtcttggatatataccggcttttctccattgcaaactcctcgtcgccaagcaataccgaacggataaccagccgcttttcatccggttgttcgtattcccggtcttcaagtatcttcggaagaaccgcatccggaaaacccagcgagatcacttccatattgaccactttacagaaacgggtatttacctgataaacggtaatggtctgtataaacttaattgccgaacgctcatacgccttccagaaaagaccttcacgatataagtatatataagtactttcggctgtctccaaagccagcttctgtttcaagtccataaataatttcttttatttgattacacttttccgccaccctgttatttgtcgcccgatatcttccatcagcagaaccagcttggcgtaactgcccgtgtcgatgatccgcagatcgttgcaaagccggatttccagtttaaggaattcgaattcgtcgacaagctgcatcaggtggggcgacttgtccaacgacacattcgcccggtagatacaacgggtcaggttcatcgcgtccttgcggatatcctgcatcagggtatatttatactctctgggcgcgtgatgcgatacggcatagatcatttttatcagttcaaccgtccgcagataaagcggagtttcagtatgtaaagccatgattcaatatttcgtaacaattatatctggatgcatatattacctgatacaattcgtcgtaatttccgggaaccagcccggcctttttctgacctcttattatagtcgagcaaatattccttacggtctggtggcgcaacagacgcaccttctctttccggattattttctcgggactgacatagtataatttgtcgagtgccggcgaaagccattccctgaccttcttccgcaagttcaaactactgtgatgcctcatcagccccaaatacgaattcaggctttgtagaaaatgttcctcttcatcttcgctcaacgggtgtttggataccttataattatattctcctatcaccttacgcattcctttcacagcccgcttccccgtcaggataacacgtccctttacgatagctccgacaaaacggataccgttcgtataatgggtcagccgtatcttgttcggatgcagggtcaaccccagttcttcctgcagatactgctgaaataaggggatcaggctctttaaatattccttgtcgttgtgtacgacaaaaaaatcgtctacataccgtccgtaataacgcagccccagcttgctcttacaataatggtcgaaaccattcaggtaaaaattggcaaacagctggctggtcaggttaccgatcggcaaacccaactcccggttacagacaaacaagtctagttgccggggtttcgtctcattcggcaacggcatgccgttcatcgaaaacagactcttatctttcggcaggcctttccataaagaccggaaaccttttatatgtaccctcgatacagggttatccaaagcgatcagccgggtcagataaagaacggtttccaaatcgtcgccttcatacctggcacgcagaaacctatccagcttatccgccagcaatcggcggtctatattcataaaaaagccacgtatatcgcactgaaggacatagcaatctttcgtataattggccgaacactgggcgataaaccgttttaagcgatttataccgaataatgttcccttaccggtacggcatgaataactgtccagaataaattctttctcaaacaacggattgatacgtgcagccagataatgatgcaccacccggtcacggaacgaagcagcaaacacctcccgcttcacaggttccgttacaataaatgcctccgaacgtgaaatcttatagcatccctcctctatctctttatataatgtatagaggttatgctccgcatccatctcaaattccattgcagcagttgttctccgttttgtcttacggcagtcgtaccatgcctgcaccaatgattcaaagtctattttcatttcctacttcattatttttagattcataaacgagtcccggacacagcgaacatagttgttgttggtgtcgttgttgttgttggtattgccattgttgaagttcacgatccagtgtttgccactactgtagaccgtactactccagtaccaattgctcacgaacgttcgtagttgccacttataacttactgccggggctccccggggtaatttcaacagggcaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaccaattgctcacgaacgttcgtagttgccacttataacttactgccggggctccccggggtaatttcaacagggcaagccctgcggacaaccggattcgtctgaatcttgacgctaccgtatgccgtaactaacggtattctgaagtccaaactattttcttatacttttctcttttttatactaaataatcacaaactatcaggcttaaagactcaaaccagtcccggacacagcgaacataccagctattggtgtcgttgttgttgttggtattgccattgttgaagttcacgatccagtgtttgccactactgttgaccgtactactccagtagtaattgctcacgaacgttcgtagttgccacttataacttactgccggggctccccggggtaatttcaacagggcaagccctgcggacaaccggattcgtctaaatcttaacgctaccgtatgccgtaactagcggtattctgaagtttaaactatttcttatacctgttttctcctttacttaaataattacatgacaatcagatttacagattccaaaccagtcccggacacagcgaacatatttgctgttggtgtcgttgttgttgttggtattgccattgttgaagttcacgatccagtggttgccactactgtagaccgtactactccagtagttattgctcacaaacgttcgtagttgtcacttataacttactgccggggctccccggggtaattctaacagggcaagccctgtggacaaccggattcgtctgaatcttgacgctaccgtatgccgtaactaacggtattctgaagtccaaactattcttttatatcataagcatacctcctttttattttcaaatttcgaccgccttacggcggtctttgggtttcaaattgttaaattgataaattgttcagtttttatcccggacacagcgaacatatttgctgtaggtgtcgttgttgtagccggtaaagccattggtgaagttcacgacccagtggccgccactactgtagaccgtactactccagtaccaactgctcacgaacgctgtgaagccgctctctccctgtaacgcagccttattattatacatagttaccagctgatccttcgatggcaaataccaatcactttttccttctgctgtaaggttactacaatatgagttagcactactccaattcatgacacctccatccgttttacatacttgaaggttaccaacataagctccggtttccccagccgcctgcgtagcactgaatgccagtgtacgcgcaggactggcaccgcttgccgataaggtaaatgaacccgtacgctcagcaccggtattggcagcacccgtaaaagtgatcgttgcatttccggtaccactggtaggactcaccgttatgccattttgggttgccggtgttattgtccacgctaaaccggctgtcgcggtaaccgaacccgttactttgctgtttgcggcagctgctatttggcccgacggattcgttcggctaaaactagaagcagcttgcttgatttctacatcttttgtcatattaccggctttcactgtaacggtggctttccgttcagtaccatttggattaacagaaccagtctgataagtcaacgtctgattagaaccggttgtgattccaccattggtagaagcagtaccattggttatcgttagccacgaaggaaagccggcagtgaaagtataggacaaatccttggttcctttcattgtatatgtaccactggcatttgctgttgcagccaatgctgctgtcggattgatagaagcaactaacgaagagggcgactgggtcactgtaatcgttttagtcaaccccgcatccgtactactgacggcactacccgcttttacagttattgttcctgcacgggtggaagcatccggattgacgacagcactataagtgatagtctgggcagtgccagtcgtgttgtttgttccgttggtcgtgcttgtcaaagtcagccaattaccggtagaagctacacccacattccacgacaaccccgcagtagcggtaaaagtggaagcattacccgtagaagcttccgcaacgactgtcttggtggctgcatctacactcaaggttgcacccgactggtttagaacgatatttcctgtcggacctgtagaaccatcacccgcacgaacggtaatcgtaccgctacgggtagaagaagacggattaacggctgccgtatagttgatcgtctgaggccctccggtagtaggtgttcccgctcctccggtatttatagtaatccagtcacccttcgttatactcgatgcccaagctaatcctgcggtggccgtaaacgaagcatcaccggtcgcaccttttgcaactatactgttaatagtcgaaccgttaacggtcgaacctgcctgactgacagctatctcctgcttcaacccagtgtaagcggcatcacccaccgaagcaccggctttcaccgtgattttaccggtacgcacctgtgcagacggattagcagagccggcctttacttgtaatccttgtgcacctgccggtgcttcactaccagatgtacccggattagtagccgaccaggccagccattcgccaccgctcaatgcagcagaccaacgcaaaccctcggtagccgtaaaagaagaagagccttcagaaccggtagttgcagccaaagaaacagaactgccttttgtcagcgtcgaaccgctctgggtgatcgttatttcctgatcaactccattcacttcaatgttaaaagatacagacctcttgtctgctctgggattagcctccacagacttaaagaccaccttggcaggaccctggtgcgtaatagttgcacccaaagggatgtcttttccgtttaataccgcagacaaccacgcaggcatatcgaatatccactcctgccccggacgggcagtgatctgtatctctttttcaccaccttttttggcaggcatttcagtaggatcgacctcgatatccggtatctcgccaaccgtgatacgctcgtcggatacgtctatacctaccaaagtaacattcatcgtataatgcgaattgcgttcgatatcataattattctcgttacgaccgggataaaaccgaaacgtaacatctttataagtaacaccgccctgcacggcattgccggtcaactcgatacaggtggcattcgttacgccacgaccgatcttcttcttttcggactcgacgatgttgtcaccgctgaccgtacccgccatattttcaggcaaataccagtaaacggtagcaccagaactactgcctgtaccggtatagtttttatattcaacaccagtcaattgtcctgtcggagcctccacctgcgaaacggatggagcattcttcaaagtgaccgatgtaggggtaaaagcaaaatcagcacccatcgaatagctaaaactgatcttggcaaggagacgggtcagctccacggtaatatctttcacaccgccggcaacaacctcaccttcccatttacccaccattttacacaagttattatcaggcaagcccgttcccgatgatgcatatggcaatgtctgtttcttcaatgtagtttcatcgacaactgcccccagatcacctgcgtttgatacgaaatacacatgactcttactaccattctggctctgcttcagtttcaggttgacagtagtgccggtcatggaagatatatactggttaaacaaacgcttaccggtcgtggcatcatactgccccacccacaggctggcgatctggctttcctgcgcttccgacaatgcagtggcggctttggtctgcaccgagtcctttactccgacagccagcgtgtccgattcgatcgtaccggcgggagtgaatgtaatgctacgcgtcacgggagtccggttagccagcacattcaggttaaaccccgcatccacatccttcaaagcatgaggcgggattacatcctcttccacatcggtctgtgtgcaactgccggcaaacaacagaagcaataccacaaacaaccacgccaacgacaagccgatacgtaaccgtccgattcccgttaaaggtttgcgccttgttttactttctcgtttcattgtatttcgtttttaatatattttgtttcaactattgtcagatctaaattctgacaaataatcagtttgctaatttccaccaataaaaaaccccaacattcttttgacagatgatggggttcagactacaggataataaaatgtaatcgttacatattcattaaagtttctagctttttagcaatagtatccgtatccggaagatattcccgataagcttccggcaacttggatgaaagagcataagtagccacaccgataggtaagttggaatttttcaaagcatactcgacaatcatacgactcttagacttacagataattataccgatagaggaattctcatgcggaagttttacggtatcattcaacacattcaaataaaactccatctttcctttgtactcaggtttaaactcacctatctttaactccacagcgatcattgcctgtaatcgtctgttataaagcagtagatcaataaaatattctctattgtctacaatgagccgatattgattgccaataaatgaaaaatctgctccgaaatcaatcaggaaagccctgatatttttaataatagactgctccagttcctcttctgaatattcattttccaaaccggtgaatccccacgagtattcatcttttacagccagtattgcctgattctttaattcttcgggcaatgtcgtatcaaaattagtctgtccaagtaaatacttttcaaaggtctgcaactcaatcttattgataagtaaatctttcgtccaaccatacttccgggtagccaaaatataaaattgacgttcctgtgtattcttacacctggtcataataacaatatgcttcgaccagctaatttctccaactaatggttggagaattgcatcagcctgatattctttgtaaaatcgggccatatcccaaagattagaagtaccaaaccctttaatccccggaaactctttctgaatatctttcgaaagattctcaacaacagatcttccccagcccaactgattttgttgctcatatatacgccgacctaactcccaataaagagatatcatttccttattgacagctttcattgcttcatattgagcagaacgaatacgggatttaacttcataaaggaatagggaatattcctttgtttctgaaatgtttgtgttattattcatagttacagtttttgttgtctgcaaagataacttttttctctattctaatgaaaatctaacacaaaatattctcttttttccctaatctgaaccccaccatgtcaaagaacgcttcggtttttaatttttcctgcaatcagaagagatcatcaacctccacctacattcatatcgttccagtttatcactttccaggtggctaccgttatcgtcgttccgatcccttcgtttatatcgggatcggggtacgggctatcggggcctcccacattgtcgtctctaaaggcgattgcattccattccagcaccttcatcaacaaactgctttcattgttctttacctccaaggtgaagatgtaacgtttaccttcgtcgaaagagatattcttgtcgatcgtcgctttcagcgtcgctgtttcattatcccttaccaccgttatttccacatcgaaaggcaagctgtttttaggcaggacaacacctttggttttattcaggccgcaaccatccggatcagattccggctccacttcttcaaactcctctgcgctaaagactacctgtgcttccaccccggaagctccccctgtaggagaaatcccggtgtcgctaccggcaatcaggccggcagcagaagaagaaatctttttgatcaccaagtcggttccatacagcttctcgaaaggaagggcattatccggcgagggagccacattaaagaccacctgcgcacatttccggctgaacgtacccagtgttaccagacgggagtccttcgtcaccgctactccccgcacaaaagaggtcatcacatcttccttatgcggaaggccggttattttataatagccgtcatccccttcctgtagcggacgcgccggagagacagcatagaaatcgtatacccctcccctcacggttagccctttggcctcgccatctatctttttcccgtttccatccacacaacaggggatcaaagtgccgtcggctcctaccgcataggtcgcttcaaacgaaggggcggttgtagaaaaagaggcctcctgaggcttatctcccacatagccggtaaagtaagcaccgatacgcacggtagctccctcaggcagaagagtcggcaacggagtaacttcctcccccgcacgggtcaggagttcaggcacgcccaagtcgggtttaccgaaactgattgctaccggccggctctcttccggcacgatctcctccaccgggcctgccgtacaccccgccagcagaccaccggccagtagcctgatcagatataactgtattcgattccgtttcattctattcattttcaattcttaattgttagcgggaggggtatcgctccccgcccgccctgtttacggcaacctattctaccggaacgtcggtgcttccaccttcattccagccggctacttgtatatccgctatctcgatgccttgcggaagcatctgaatattatagatataattgtttcccttcaaccagttggcggtaaaagtaccgggagtactgcttccttcgccaggagccatcgtaaagacacggccatcatcgagcgttagctccaacgtgacagctatgcccgtcacagggatcaccagcccgaaggcctgtaccgacacctttttaggatcggtgacattcgtccctataccacgcatatctccgtcggccgtgaaccataattcatctacagcagtcgtcgtgccactcaactcgcccgtttccagacttaacttggcggaagtagactttttaaaacccgcgctgcttttcaatacgaccttctttacagtgctgcccgcaaaagcagaacctccatccgcttccagaatacggaaactgaccttcgccagtgcatgatgcatcgtgagcgacacttccggattccaccggtcgacctcggttgaagccttgcaatacaggtaatcatcctgatcggactcccactgtacatcggtagaagcatccaccggattaccgccgtcgctgaagtaaaacttctgcttatccaatacctttatactactcattaaaggtactttcggattgcctgacagcgacacgctcttctccaccggtgaaaaagcatacaccgttcctttatccgaatacaaaagaagctgttcttccccttccgctagttgccagacagccggatcgacctgcgtattgtaagtgaacacctgggtattatttccgctggcatagacactcaccgaaccgctgctgctctgcttcgtgacacaaagcccgaccgtagtcaacggattcggattggtgtcaccgcctgcgggacctccggtcaccaggcttctcgtttctatctccaccgacaagcccaggttctttaccgacaaagggacacctttgtctttccccccgtctcctccatcgccaccggctaccggcaaaacgatgtcggcctgtgtacaggcagtacacaaagacaggaagaccgctagcggaaatgtatatagattctgtttcatgggctttgttttaatggaaatgattacagcgggatttcgtcctgttcgttatctacccatgcttctacggtaacatccattaccgtcagcttattacggccggcagaaagcgtatagatgtaattgttgttggcagcccattcattggccgttagggttaccggatattcgacaggagtgttagcaccttcctgcagagtaaccaccacgtcgatctcaccatcgccgaaagttgtaggatacacaatggcactgatcgttttggataccgatttaccgtttatagaggtggtgctggtacctgtcgatttgaaagcgtgttcaccttcaactcccgttgtcggatccacctgtctcatcaaaatatagttcgttatcgtacgagccattccggttgtcgtagacgggccggtaatcgcaccgtccaccaaagacatggttccgtttcctaccttaaaaggattggctccggaagtagcattgttctttatctcgaacttagtaaatttcacgtcattagtactcaggttaccgccgtcgtacacccggaaagagaccatagacatggcatggtgcatatcgagattgatcttataaccgggattgtccgtattcttattatccggttcggcatccggagtgaccggtgtttgtccatcggcacgtccgttatttacataacgtccttctgttcctgcaaaataaaggtaatccttttcagttgccagcgacaggttcaccagatcccccttggcagtcgtaccccagctaccgctgttccaatacttcttcgcattgtttttcgtggcatctatctcacctgtagtcaataccgttaccgggattttcaggtcagattccgcagatatagaagaaagagaggtcgtaatatccttactataaggataataggcatatactttacctactgttttactcaggtaataaggagtttctttcgtatcggcaaaagtcgcgcctttactatctttgacagagatccagttacctcccttttcatctcccagataccatacatgatggcccgtatactctgttccgtcgggcgtgtaccaaccggtagcaccgctgttcgtaaccaatacacccaaccccgggactttatcgctgtttgcaaaatcattcttatcgtaagcgatcgtctcaccgctcacgacagatttggtagcagccttggtgccggcatccactttcagattaggtgtgatacccaaggctacctgatcgccatcgcctgagtcgataattaaatctgtttctgtctccgaacagcttactgctgtcagcagggctatagccatagcccccattgtcattgtctttttcattttcgttcgttttaatataaatactagttataacttattctattacttaaatcggtatttcgccggcatcctgatccgcccatcgctccacaccgaccgttgtagcctgtatcttccgtccatcggtgaaaaacagggagacgacatgccgtttgccaggcaggaagccgccctctacggtaacagatacacgggaaagggtctccaccgcattgccgttgccgtccttcgttgtcgtcacatgcaattgcagcggagccgacgtggcgggaagcaggacatacccctgcgcttcgggaagctctccgccttcctccacctcgggaatcgccaggccagctatctcctgcacggcgacagccttaatgtcttccgtcgaagaggcatcggacaacacgggcgatactgattgccagtccagttgttgccgggtatgtacccccgttacttctatccccgcgatctctccccaacgatctgtcctgtcgctgtaacaaagcaggccgagttgagtcagcaaatgatggaacgtacaggtgcgcaggggagcaaagctgtttcccgacaaaggtcccgtcgccatcacatctgtcattccgtctattgtaaaggtcatccggcctgccgtagcatccgcttcaccggttaccggataatagccatgcaaacggatattgcttccatcggacggatagagctgcgtctcgtcgaacacgaccggacggttgcccgccccgccgctccggacggctccggatacactccacgtaccatacactccggaaccggtttcatcctgacgggcaaaacacacagccagatccttttcatagccggagccgatcactgcacgggtagacacaccgatcgccccttccaggcataccgtcgtttcggggacaggctgcggtgtaggatcgctgccgtccgaacaggcggttagtgcccgaaggcaagcgatggtggctatcactattattttcttcatctcctgctattctaaaaaaggttatattccgggagtgatagtagaactgcctccgttacccggctgccattcggcaatgccggcttcgatggtgatctcaccgtcgatggtgaaattgagggtgatcaggtgcgactgtcctttctgtgctcctccgctgatgttagtgatgggaacctgcaatgttttctcagttccatcgtaagtagccttcacttccagattgatagcggcagactccgtacccatatccgctaccggataaatcatcagataaccggtctgcggatcggtagcatcggggccggatacctctgccggacaaccgatcacattcagatcggtattggccgaaccggttgtcgtcagcgtggcaccgctcgttttgtcgagcgacaacgacagtgtttcataaacgttctttaccgcaatagaagaaactttcgtccatttcttaactgcttccgccgaaccggaacatttgaattgcaactgggtaagcaggtgctgaaaggtaaacggggtaaacttggcgttcgcagcacctgtctgcacttctgtcgccataatatcttcgtcaccggtgatagtgtacgaaactgtagggttgttttttccactcagggaggcttgcggataataaccgatcagagtcgactgcccattggccgtcatatacgtctgtgccgttgcaaaggtaacggaggtattgccgtcaccgccaagacgggtggcatcgatagccggtgtagtccaatccgtatttgataccggattatccaaccgggcaaacgatacggccaggtcgcttccataaccggcatcgatcaccgcacgggtagcctctccgataccggcacttacctgcatcgcttctccccggccggcaattgccggttcttcttcgttggaacaactgcacaaaaaggccgtagccaacatactcattactaaaaatttacttgttctcatattatactagtgttagaaattatcaattattactccgtcaccgtcccgttgccggaagcacctacctgccagggagcgactgttgccgtgccttcaatcgcaacttcacctgttttcagaaaggatagggtcaccagatgcgaattgccggccaaggcattcagtcctgcctgggtagaagcgtctatgatattaatttctttactggttgtaccaccttcataggtcacttttactttcacgccatcgagagccttcaccataaaaggctcgccgaccttcgtcacttctttggtcagttggataggagcggtaacacccggaacagccagggtagccgcagtctcataagttacggcaccatcggcaatcgtcatcgtcttcggataggcagcgtctacgacttctattttagatatcttcttatccggattcgcccccaggtaaccatccgaagcctgcacctggaagtttagctgcgtcagtgtatgggtgaatgtaaatgcacctgcgggaacatctttatttccactcacaataccgccatacatcacatcttccgttcctgtctgctgaaaggtcaccacccctgatacggaagcgatttccggatgccaggctgccatatatacatttcctgcggccggatacactttcgatacattcaaaggaaccgaagttcctgtcgccgtttcggacgctaccagcgtgatactgttctgccaggcaacagcagccgtccatgatgcaggcggctgggtcccttcaatagctgtaatagcggccgtaaacgtatcacccgtaactaccggtgctttggtaatcgctccgctcacagtggctcccaccctgatctctgcggtttgaagagctccctcctcagaagaagaacaaccggataccactaccgccaaaagagcggcacacatacaaacttgtctcatattttccttttattaaatgattaaaaacagatattcaatcgataattcccgttccgttattccctctcttccactctgacacctgtgccgccagggagtaactgcctcccgcacggagtatgacagataaaaggtaagaggtacccggaaccgtataaccatccgattcgtgaaacgataccggcaaattttcaaagcgggtcaggttaccccggcgatcttccaataccaccgtcaggccgaccgttactccggattgtatcatgaccatctccgggacatccagccaatcggaatccaatggcaaccgttcaccgccatccgtccggtcgagaacggttaccgctcctttttcaccggagaaagacaatcctttatttgccggtgacaaaacggcttcactttgtactccttccacagacagtccgaacaatttccaacccttctccttccccgccgtatcacactggaaacggaaacggagctgagtcaataaatggatgaatacaaacgctttcccctcctgccaaaacatatccgtcaggcaaccgttttgttcgccggttaccagaatatcctgttttccgtcgatcgaccaggctatctgtccgtcatcacttggcctgcctccgggagcaaatccgcgcagataaacacggctgtcatcggatggataatatttcggttccgccaggtcagtgctcccgtcagcctttacgtaagctttccatatctctgtatactttcccgattcattgcctttggcaaaaaacaccgtatcggaaaaagagagctctcccgccaactgttccgaagaggcacgaagcatcaacttttgcccgtcctcaaccggaaatcgaccgtcaccgtccgaacagccagccatcatcccccacaggaggaaagccaatagcggcaaaggccatcgtagcgtatgtttgttttctatcttcattgttatatttaatagttcaattattgctaattaccgacttcccctattccttctttccagcctgtgatcgttatcgttgcgccatttacttcatcataggtgacctccaggtcgagtacgatataggccgatacactcgtttcgaatgcgtcgcccacttctccggttatattggtcaatgaagtgatctctttcccgtctttcaatgtgagcgtcaggtaaagttcgaccggttcgcttcccgctgttcctcctgacagaccgaacaggttaagggaagaggtatacacccccggatcggcctgctccggctcaaatgacataaaagccggtgtgtcaaacaacgctttcccggtcgggatatgtacctgcgacgaaacacctgtcaaccggccggataggtttacagaccggacatcctcccctcctgttacttttatatttagttccagggttttgaccaggctgaccggatacaactcctccacgacggtctgttctcctccggcatcaatctgccggcagcccgtaccgtataaattgccgggatacgcaatatggacagtagacgattttaacccggacatctgccgcgcattgccgcaagcctgttcgtagccgttatccatatcaagtatgacattatcgcaatcggtattgcacaccacgaccctatattgtcctgccggcagggtaccttcgtaacccgaagcacttccccgacgaactaccggatgcccgattccgtctttatagaaataataagtcatgcccgacggatattcgctacgcgtctgccaatccagatgcaggcgcacttttccattcttctcccaatcctcatcaggcgtatggtagacacacgacgataggacaacggcacctgcaaaaaataccgcccaacccctaattttaccctttttctgttttttcatatttctacccttttcttatctgatttgaaaacgatacaccaggctgactttcagcccaatcataaaacccgtcgatgtgaaacggctttccaggtaattcgtatcgtctattttatcgtaacggtatttcttaccgtcaaagaccgaacgataacccgtccgcagacttgcctcggcgcagaaacctttccccaaaggcaccaggcaaccgatcgaagcacctaccgtccagaaacgacccgtcctgccgtaaagcacatcagggtcgggatcaatctcgctgccccgtacatcgaaatcaccgtattcgacgaacaggccggtattcaaccaactgaactcgccgggagccagtggccacacacggggttcgaccgaaaattcggacaccgaccagcggtcgcgcgttttatctttataagcaaaatcggaatacatacccgccacaaccaccgaccaacgttcagcaaaataacactctgcctctatattcggcataaacgaccccctttgcagttttacatctcctgtccctaaactgatggacggagccacagtaaaccagggcagcagattcgttttgacagccatgtgtacaggacttaccgccatgcgggcagcagacggccggacgacaaccgttaccggatcactttcgtttgcccccacatcttctgacgggattttattgacaggtatctccttcctgacaacccgtgtcttttcatgggttgtcaccattgtcgacgaacgaggattatctgacggcatatccacaaccgaagccagccggtagtcgtccagctccgaacggtcgaacagcggatcgtcgatacggtacaccacccggtcatagccacctacctcaccacgacggtaaagatccacaaaaggatatgcaccgtatttttccaaagccgccctgacagccaccggataacggctttcactgtaacaaatatccgtattggcaaaccaaggcagcggagattccaccaggtagacatgtacccggtcacggtaattaccgctgcggtcgatgtagaacgcaacgcattcacccggaatatccaaacgcgttttaagataggcacggatacgggcggcacggagcgaagcctcattgatcacggcatcctctttagagtcgtaagcactcacatgcgagacgatcagcaaatgacaatctccacccaacaggcgattacgaaaaacaggtaactgctgtcccatacgttccaactggtaagcattgtcgccatagtcagccagaaacatatcactaccttctttaaaagagaataaaaagaattccgctttcgtataagaagtcgtctgagcatttgcctgcaacatacactgcccacaaagtataaacagacccaatgctgcctccatgatccttctacatatttgctgcttcatattacgcatatttcgacttactttgattttcattattaccaactcttgtcatccttatttatataataaggtaggaaggtaggaaacaggcgttttaaggagagtctttttccctttaggaaagggaaatcaggcaggattgatgtcttttttaacggcttgctaaggaaaaataaacagaaatgggtataattttttccaggcggatatgaaaagatgacagtcccgcccccctttatgtcaacacgactgataaatcaggttgtgaggctacaaagcaggcaaataagtaaagttatgttaaatcattgtgctattttttacaaatacatctggagaccttgtttatccgatatattctttctatgtttgcatcggacttcatcataaatgacaaactatacatagcctaagtctctgtatataagatgaaaaaagggtattctaccttattatataaataagggtatcgactacagactcaccaaagcacctatctctccggaaaccagtctattagcctccgccagtttatccgtactgaaagctgtcagatacgtatgcgtcattttctccgaggcatgccccagagcctggctgataatcgataccggcacatgacggtgataggcctcagaagcccaggcatgacgaaagacatacgtggtcaacgtctccggcaaattcaacatgacgcagatttctttcagataatcattttgcttgcttaggcagtatttatactgttcgtgcgaggcatcctccggcaagaccggaaaaagatacaacgcatccggacggctgtagcggtctatcagatgctgcatacccgttgttatctctatctggatcagtatacccgttttctgacggttgtacgacaaaatcctgccgttttcgattatattctcccgcgtaagatgaaccagatcgacaaaaggcataccgcaagccataaaagaaaacagcgacaggtcggctgccagctgtttttcaggttcctttttcagatccagcgaagcaatcttctcgatcactccgatcgatacggcacgtttgcgtgtttcctcccgctttaaacggacacctgcgaacggtgactcctgaggcttctttttccaacccaggcacgcacggttatacatggcacgcaggttgctgatataactgttcacgctattcacacgcagccccttttcacgcagccattctacaaaggcacgcaccatctcacccgtcacacgcttcaagggcagttcacgtccttggttgaagttattaaagtggttgcgcacagcacggtacaagtcggcagtactctcatcgccggcttggcgcttttcctgctcctgtttaagcatttgaattctaaaatctttgtttttcatactctttccctctattttttattggagggcaaagatataacatttgacgaaagataaaagttacccgcgcaggcattcgtcattccctgcgcagccaattgttgttagctgcacagggagtaaagattagatgttatttcaacctattcacccgcgccacatccgtcaactttacacagactgttgcgcccagttgctccaggaagagcatgaggtggttcttttttatcttctttatctttcccgatacatgccgcatcgcaccggtaaggatctctacctcctcacccggacaaagctcatgttcggcagcctgctccaggaactccttgatagcatccacttcgacctggcggacaatagccggttttccgttataaaaaacaatccggataacgccgtataccttcaataagtcgcgcaaaactgcatccgtacacctgacaaacacatacgaactgaacaaaggtatctcaactatcttcacacggtccgaccatacccgcggagtacgatgtaaaggcaaccagcattctactcctaacaagtcgattcgctcttttacctgcttttcggcacgcggagccgtatataaaacataccagttagtatcttgaggggatatcattgacatttttttttattcagggcacaaatatagaactatttttcgtattattgcaaagctgtttgcgaacacataattttaataccatgaatagaagaaattttttacaaaagtccgcattatctgctgccggactaggtttatcgccgttattcggtagtgcgtacggagctgtttacggacagacggctcccagcaataaagtaaaagtagccctgatcggatgccgctcgatgggtttttccaatctcagcaatttcctgaaatatccggaagtagaatgcgtagccctttgcgacatagacgacgaatggctgaacaaacgggcagccgatgttgaaaaagcaaccggcaagaaagtccctaacttatataaagactggcgcaaggtcatagacaataaagatatagacgcagtgatcatcggaactcccgaccactggcattgcctgcctaccatatacgcctgccaggcaggcaaagacgtatatgtagaaaagccgctttccaacaccatcgaagaatgtaacctgatggagaaagccgcccgcaaatacaaccgcattgtacaggtaggccaatggcaacgcagcgaccctcactgggacgaggccgccaattacctgaaagccggtaacatcggccgcatacgtacggtaaaagtatgggcttaccaggatggcaaacccaccctgcccgtcattcccgacagccctgttcctgccggagtggattacgacatgtggctgggcccggctccgaaacgtccgttcaacacctaccgtttccattataatttccgcttcttctgggattatgccggcggcctgatgtcagactggggcgtgcacctattggattatgccctcgaaggtatgaatgccgacctgcccagccgcgtattctccggtggcggcaagttcgcctatcccgatgatgcgatggagactcccgataccttgatggcaacttacgcctacaacgatttcaacattatctgggatcatgcctgcgggatcaaccacggcccgttcgacaaaaaagagggactcgctttttatggagaaaacggaacactggtactcacccgtgcaggctgggaagttattcctgtcgttgccggaaaagaagcacgtatggaagccgttccgttcaaaaaaggggaaggtaaagggttgtacaaccatgtcgggaatttcctgaactgtatcaaaagtcgcgaattaccccatgccgacatagccatcggcgcacgggtagccaaaatgtcgcacctggcaaatatttcatgccgtttgcaacgcgaagtacgctgggacgataccaacagcctgtttgtaggtgataatgaagcaactgctttatcaaaagcgtactaccgggctccctgggtattgccccaaatatgacacaacaagcattttccacatgaaagccttgaaattcttttggtaataaatatttatatgtacatttgtacaatatacgattacatataaatatcatttacctaatatgagcagcgcatatgcagactattcaagagaagagttgatccgtgaaattgagatcttgaaaaaagaatgctcttcttttaacgatggtgatttatataagagccggatgctgatagatatgatcgcattacggaaaacgctttccgatgtgctgtccttattattagggtcggaacaaaacgaaacgatcgaccaggctttgcttattgtcctacgctttttcaaagtagatcgcgtatacataggtatattcgatgaaaaaagatgtatgatagacttcacgcatgaggtgacgcacgaaggggtgatctccatgcgtgaagacttgttgcggcagttgtcgacagaagatatcccctggtggatcgaacagataaaaggaggtaaagatgtcatcatccccgatgtggagaaaatgccccgggaagctgcggcagaacaacatctgctacatttgcaggatgttgtctcccttttggtccttccggttttccatatgggaaaagtcagcggatttatcggactggactgcgtgaaggcccaacgtacgtggaatgccatagacgtggaaaacctgcggatgctgaccgatatcgttttcatagccatcgaacgggaacatgcacagggcatgatggagtactccatgaagcaagtgctgcaaagcgaatccaaattccagatcatattcgaccagttgccctggggagtggaattgtacgacgagaaaggcaacctgctcgacctgaataatgcggatcttgagatattcggaaccacgcgcgaacaggccatcgggctgaacgccttcgataatcccaacatcccggcatgggtaaacgacaaactgaaaaaaggggaagatgttgccttcacgctgatttataacttcaaagctgtttcggaaaccggctactaccggacaaccgtcaaagatcatatcaaatatttacaggtaaaaggtgtcgtcctgaaagataaacagggcgtcatattcggatttttctatatcgtattcgacgatacggaaaattatctcaaggcggagcagacgcagtacaatctgaccaaactgaaagtcgctgtcgacaccggcgactctatcatctgggagtatgatgtggcttccgacaagctgaatgtagatttcagcctgagtgaaaatattggagataacaagctcctatcctatctaaaccgggagaacctgaactatatggaggattttgccggaactttgcacccggaagacttcgacagggtatacaaccaacagttcaaaaggctgctcaacggtgaaataaacagttatgcgtcggtataccgccgtatcctcgacggaaaaacatactggatcaactcgaatgttcgttcttacaaactgaacgaagatggtacgcccagcaaaataataagctacacctccaacatcagcaagcaacgtgaaaaagagatcgaactgatcaaggtaaaagaggcggacaaacttaaatcggctttcctggccaatatgagccacgaaatacgtacgcccctgaatgctatcgtaggcttttccgatctgatagcggaaacggaagacaaggaagacaggcaagcatacctggatattatccataagaacaacaacctgttgctcaacctgatcggggatatcctggacttctctaaaatagaatcgggcacattacagtataacatagcacaaacggatatcaaagagctttgccgcgaaatacaccaggcagaatcgctcaaaatgacttcggatgtaaaactgctgttcgacgacaatttaccttccgtcatcctcaagacagatccacagcgggtgatacaggtgattacgaactttataaacaacgcaatcaaatttacttccaaaggcagtatcaccatttcttatgccagaaagaacagttttctcaaaataagggtcagcgataccggtatcggtattgccgaagagaaccggggccgtatcttcgagcgttttatcaaaataaacgactttaagcagggtacgggactcggccttacgatcagcaaaatgatcgtggaaaacctggggggcagtatcggggtagattcggtgcagggagaaggctctactttctggttcacgcttccgcttgaaccggataataaagatatacatgaattaccggaggaagaagaaacacctctccctccacccgtagtcgaaaagcctgtttccaaaaggaaaaaggtactgatcgccgaggatgttcccgaaaactatttcctgctacaaacgttgttcgggaaaatatatgagctacaccatgcctggaacggggatgaagcggtagacatgtaccggaaatatgatccggacctgatcctgatggacctgagaatgccggtaatggatggcttccaggcaacccgtatcatccgtgaattgtcggagacaataccgatcatcgcattgactgcgtttgcttttgaaagggaaaaagagattgcccgagaatgccgttttacggattatgtggtcaaaccggtcgatattaataaattaagggagttggttcacaatagattatataatagataaggctacacaaaagaataggtaaagcaacaaaaagccggttgaaaaaaatcaaccggctttttatttatcctgtatgtctattattacggcatcggagcagcagaaggcggaggcgttgcagtaccccatgctttattagcccgtgggcccatttccaattccaatagaccgccctgagcgatatcgctgtgccggaaccagggctggttcagtacttcaccgttcaacttggccgactgcacgtacttattctcttcggaggcattgttcgccttgatctcgaacgtattgccattccccaggtcaaccttcacatcggtaaataccgggctgcctatattataggtaggggaaccgggagtgaccggataaaagcccatctggctgaatactacgaaagcagacataccgccgccgtcttcatcacccggaacacccatcaggtcgttgcgaaaccactggttgagcagcgtacggatacgtttctgcgttttccagggctggccggcgtagttatacagatacgggatatgcaaactgggttcgttcgccatcgagaacattcccacgttaccggtatggtcaggcaggaaagaataaaaactccatttggacatacccaagggttcgttaaacatagaatcgagagccgaagtgaagaccttatctccaccgatcatagagatcaggtcgccgatgttatgctgtacgtcccaacgatagatatagccattgttttcgtcataataatcgcgtgcacccagaccgccgtcgtaacggtaatccatcggttcgataaatttgccgtctttatccttcggatggaagaagcgggtgtcggggttgaacaggttgcggtagttgtacgattcgcgcaagtaatgctttgcctcgtcttccttacccaattcggctgcgatctgcgaaagacaccactggtcgtaagccgtacctaatgtaacggctacgggctgacgtttttcccagatagatacattttctactgtttctttttcgccgggtcttaaggccgggatataaccatgttccttatagaaatcatccaaccatccggcaggtttagccgaccagggaatcaaggtcttttcttcgatacctttcttcgatgcgatataggctttctccaggtcgaaaccgcgtaccccttttctccaggcatcgatcacggtagctacggcatggttggagttcatacggcgggagtcgccggttacttcggggaaggtcggcatccaatttgtccccatctgttcggccatcaataagaaggagttgatgatattgctttcttcctcgttgtcgatcaggatgcgcagcggatgagtagcacggtaggtgtcccagatccagtcgtcggtataaaacggccggccgccgtcttcgtgtatctttccatcgaaagcgctgtaataacggccgtcttcgctcaggttgaccggacgttcgtagcaacggtagagagaggtatagaatacgaccttatcgttgtcggttccaccttgtgtctgtatcttgccgagagcttcgttccagtcgttgcgggcgatcttggctactacgtcgacatcataagcggcaatctcacgttcgaggttcttctttgcctgttcttcgctgataaaggagataccgtaacgaacacccagttgcttgacatcgttaccgtaagccaataccagtgcggcgtctttcccttccacggaggtttccccgtacttcacagcgttgtcagccagtacaccgcattgctgcggagccatgtcggtttcggcataaagatagacttttgtctttttgtctacgaactggtaaccgctgatattcttgccatcgctcttcaactgaccgttgcggctgttgaataccagataggcaggtccttccccttcgaaggtgatattatacacggcactctggtgagacggagcgtaatctacagcgatattgttatcatccagatatacctcgtaacggtacggacggatcttttcatgatcgtagctgtagttgataaccggcttcagtccggacgcttctccctgatacgggctcaggttgaaggcggaacttccgcggtggctggtcacgataataggtaatccgcttaacatgtcgcctgtaaagtcggcacgctccggataaacacggagcatgctgttaggtaaatgtatcgtcggataggtaggcaccaataagtggctgatatttcccatataagggttcacataatctaccgggcttttctgtgtggagacatcgcctccggctgcacaagaggccagcagaaatacggaagccaatagggccacacctgttttaattttcttgtttacgttcatatacctgtctgtttatttcttttttgactttgcagccggaaccagcttcttaaagttctcgtcgtcgacagagaatgaataaggaaggtcttccgggttaacgcctctgttcaggttgggtttgtcgcccatcttgatgtcgagaacaccgcctttcagcagttcgttatggtcgagataattcttggtatagttcacaccgttgaacgacatcgactcgatatagatgttcttgtcgctgttttcaggagcattaatcaccaggttctttccgttctcgaaatgcaaagtagccttcttgaacaacggagcacccaagacatactgggtcgtacccggtgcaaccggatagaaaccaagagcggagaatacataccaggcagaagtctgtccgttatcctcgtcaccgcaataaccgtcgggggtcggggtgtacatcttgttcatcacgtcgcgtacccagtactgtgctttccagggttgtccggcataattgtacatatagatcatgtgctggatcggctggttaccgtgtgcatagttacccatgttcatgatctgcatttcgcggatctcgtggatcacctgtccgtaatagctgtcgtcgaacaacggcggaacggcaaatacggagtcgagcatcataacgaaagaatctttaccacccatcagatctattagtccctgcggatcgtggaagacagaccaggtgtaatgccagctgtttccttcggtaaaggcatcgccccatttcaacggagagaacggagactggaatgtaccgtcggcgttcttaccgcgcatcagtttgctttccttatcgtacaggttcttatagttcatcgcacgttttgcgtacagctcgagttcttttttcggacggcccagttctttggcgatctggtagatacaccagtcgttgtaggcatattcaagcgtacgggctgcgttctcgttgatcttcacatcgtagggaacataacccaatttattatagtattcatgtcccagacggccggtagatgaaacggtaggatgtacgttttccgttccgtggatcaagcctttataaagggtttccaggtcgtctactttcacacctttcatataagcgtctaccaggacggaggcggagttgttgccgaccatacagccacggtgaccgggacttgcccattccgggaagaaaccgctttctttatatgtattgatcagaccttcctgcatttccttgttcatagtcgggaacatcaggttcaggaatgggaacagggcacggaaggtgtcccagaaaccggtatcggtaaacatatagccgggcaaaacttcaccgttatacgggctgtagtgaaccacattgcctgctgcatctatttcgtagaatttgcgggggaaaagcagggcacggtacatgcaggaatagaatgtgcggtactggtccaacgaaccaccttccacctcgatcttaccgagtacatcgttccaggcttgtttgcctttagccattaatgtttcgaaagagtcgttacccagttccttcatattcacggcagcctggtcgaagctgatgaatgaagaggctaccttggcatgaacgatctctcccttacgggtcttgaagccgatcacagctcccacatgtttgtcggtctgttccttcgctccttctttcaaagagttgtcggcaaaagtagcttcataagtgaaaggtttgtcgaactctatgataaagtagttcttgaagttttcgggtactcccccactgttctttgtcgaataaccgatgatcttgttttcttcggggatcaccttgatatacgaagcattgtcgagtgcatcgacaacgatataagaatgatcgttctccgggaaagtgaaacggaaaagagcggcacggtcggtcggtgtcaactcggtgatcacatcgtgatctgccagatatgctttataataataaggttttaccacctcactcttatgggagaaccagctggcacgtttatcctggtcaaactcgggagcgcctacgacaggcataataacaaactgtccgtaatcattgatccacgggctcggctgatgagtctgtttgaaccctctgattttattggcggtatatacatactgccatccgtcccccatcttaccggtctggggcgtccagaaattcataccccacggacgggcaatggccggatacgtatttcctgtcgacagctcgaaactcgattgagttcccatcaacggcagtgcgtactctaccggatcaaacgcttcatttcctgaagccgccatggcgggctttcctacaaaagccaacatggcggccaaagcgaaagcgcatacactttttcttttcatgatttagtttatatttggttcaattactaatacattcattgatctttaataagcacaaagataatcactatttcatagcagaagaacacaattaaaattaattgcgtttgaatctattaaagaaatgccggaagtaaacttcttcacttccggcattttattaccaatcaaaagaaacctgaatgccttccggagcattctcgaatttcaacagacaggttcgactcacgtcatcccatgcatagatcgcatcggcaagggtctgccctttagcatccgagacagtgaccttctccggcttctgcggtaataagacacgcatcacattcgttgtgttgaccgggcttttagcaacaaacgaataagcatttttgtttactttttcgtcatacacacgtgctgcgccgcataacacctgtggcttgttccggttttccacccggtcgatattgaccagataggcttgttcacccggatttattatcttctcgctcagaacgggtaactccggatcaaacagatcgatcagtctgccttttataatatatggttcattactaatcattccttcatccaacacggataccagatcataatatcctctttccagatagaaattattcttgaactgaagattgccggcattggctttttcttcatacaaacgtttcaccgtagccacgaaccctttgtcggcatctgctttcaagacaaactccttcgggtcctggcgaacaacgaaaaccgttcctttgccataagtatattcgccctctttagcgtctttgtctattcccatcaaaccgaacaggtgctgagaaggtgttttatacttttccgtatcctggttccaccattcctgtaccgactggaaagggtccgtatcgcgtgtgctgtatactaatactcctccgtttttaacccattcggcaatatacttatgtgtttccttttccagaggtttcatattggaataagtcatcaacaatactttcgtattttcccaggtttccggataagatacattctcgagatgcaacagatgtacagggactccccgtttcaggaaaggcagggcctggccgtaaaagttagataactgcggatcgtcataaccggcaaccggctggggtgcccgctggaacatcaacgagttggccatcaaaacactgataccggaagatccggataccttattgtcggataaaggcatattattcagtgaattgatcatgacctgcatttgggtggagtagaaacgcgggatgcgtgctttctcttcactgttggcacttttacgatataaaccttcataaatacggtccggccacggcattacttcgtagttattattgtttgggtacaatagcttggctgtaaaggttgcctggtagttcttcttatagtctgcccagtcgcgaggccagtcttcaatcgggtcggtcaggaagaataccttacggccggtcggggctgtcatcgattccatgcaaccgtattccaggaaggcggtttcgaatacgcgttctttagcaaccccgttgaagtagttcggttcgcgggatgttcccgtccatacctgggcgatatatccatccacacaaggcagagaggccaggcttgcttccggacttacgatctgccactgggaatagttcaccagcgaatgggtaggcacataacagcgcacatccattcctttgcttttaccgtattccttcgcataagtgaaacattcgttcaatgcccggtaatacagatggtatttcagtttattggaaagataagtattctccgccgattcatgttgcggacgccagtcgaaaccgtaatactctttccattcccttttgaatgcttcactgtaaccgccacgggcccagaattcaggttcttccagataaatggcatcgataccggcatcgatcactctctttatatgttgttcctgcatgtatttgatgaaattctttgaaggaacgatataagggaccagatggccatgccaaatcgtatcccctttcatcgttacctgtccttcatccaaatgccacttaccatcccattgaccggtaaaataatcctgatattctccccaggcgattcccgtcataaaatgagtggtatatcctttatcacgccagctttgcacacgttgttcaaaagtaagaccggaacgtttttcggaagggtttcctcccactccataaacgatagccacatcggcacgcacatcggttgtcggtttccagggttgaccggtttgaaaggcggtcttttcccgtctttcggcaggagtcgcttccgctcccttttctcccctttgcccggtcaggcaggaagtggttaacaaagaaaaggccatacaactcaatactagtttttttacatttgtcttcatgatttaaaatttaactgttcgatataaaaagggcaccctaaatgtatgaataatccagataaggtgccctaaaaaaattacattagtctgcttatgggatttgaatggttatcatttccgtataattataacgcctgctaccttctatttccttatccatacgggcaccaactctgaaatggtaagtaaagccggactgtaaagcagtcttggtggtcagtgtgaccgttgttcccaacattgcactggcattatcaccgtcgatatagacagagtaacggtcgtctttattattttcacccacataaggagccccggcaacaacgaagaaacgaacgtccgatactttctgttgataatccggattggttgttccccgtttaatcgtagcctttactgttacggttttatctgcattgatcacgggttcgcccacccaatcgacattcaggaacggttcgacttccagcttcaggtctagcgtaccttttacttgatatctttcttccggaaccgggacgaaagctcccataacagtaataccatattcaccggcaaagatcttttcattcttaaaatctccctcctgcataccaccaaaatagtaaggagtaggactttcgctccagctgtactccatcagtttaatgcgaacacccccttcaccgacttccgtctgtacgggtttctgtgtattcttatcaattacaacccctttgatggtttctttaggctcttcgtaattatcaaatttagtacaagcattgctcgttagcagcaacagagccgttgaaaaataatatattatctttttcattttatttctctatattaaattaataaccaggattctgcgtaaggccgctcttggtaacttcgtcgttgggaacttcattgtaataccatctttcgtcgaaagtaaagcgtttgttctgatcgtccggtctggcatcaaagaaccatttgtttgctttttctgcatagaatgcaaacaaagatctgtaacgtgtggagttttgttctttatgagcggttctccaacgtctcatatcccaccagactttgttctcgaagctgagttctttacgtctttctacgcggactgcttctttagtcaattcattcttgccggtcaataaggttgcaccagcccgttcgcgaacttcattgatacattcgtaagcatcttgcaggtaatctacgccggtttcaccttcttcatatagttcgtaagcagcttcggcacggttaagcaggatttccgcataacgcagctccagccaggattgatccgaacgtctttccatcaccagctcggcaggcatatccggattgatccatttgcgaaccacaaaaccggcaatagcaccttcacccgagttaaagaaacttccgcttctaccgctggcattcatcttttcaccatttggtaaaacgtggactgtctggttgtcggcactctgggaactaacaaataagtctttgcaattggcatcattctcatatttctcggcaggatcatcgtctttctgcaaacgagggataccatttgttacatcgcccgtataaataccacgccaaagctcaacctgttcgcctttcaaatcatctcccggcaggatgacaattgcccttaaacgaggttcagcctctgcgaaaagatccatcgttttatcaaacagcttataggttccatctgcattaaaaacatcgatctgacctttctcgtttttaggataacctccgaacatttcaacaaaactaagtgtaggacttgttgaagccgtccatccgtttgtacggaactgacgcgggatattgtaagcatcataaccatgtacggactccggatagctgtactgacggatgaaaatattctcgctgctgttctctgcaaagaacatatccacatagttctgatattgtgcttccttgtcgtcagccttccagccatctttatacagagaatatttacctttcaataacaaagcagcttcataactcttcttaaaatattccctggctttttccttagggacaccacaaacacgaatgctattgtcgttattgtcccttttatcgacctcattgtactttgcaatagaaccggcaaacaacatcgctctcgatttaaaaccggcagctacatatttatttgcccgacctttctgattgctttcaggtaatagccgataggcctcgtcaaagtctttttccatttgatcataaacagcctcttccgaagaacgctgaatcttcatatcctcaaccgattcgctcggatagttaagcaccttatttacaatggggacaccaccataacgttttgccagcgcatgataggtaagagcccgcatgaagtaagcttctccagtccaggtatctacctgatcctgcgagaagtttgccgcatattgaggcagtgtttccatgaaataatttatttcacggatcagtttgtatgcatcgttccatatctggttcgactcggtagccgctccaccaatatcacggtttaacgcctcacctgtcataccgaaagttgactgaaaagcataggagttattaaatccacgtgtatgtgaatagcggaaatcttcaataaatgaattactatacaatcttgacaaataactcttcaccccattctccgaagcaaaaacatcgtcattctgaactatattcaagggggggatatccagatccatacatgaaggcattccacaagccaacgccagtaataatatatattttgatactttcataactttagaacagattaaaatttaacatttgcaccgacagaaaacgttctgttcagaggatacatattgccataactatcttccggatgttccgggtcaatctccacaccttttatagtgaacagattataggcattcacatacaggcgaagatttttgataccaactttagatacccatctttgtggcattgtataaccaatttccgcactctttaaacggaggtagcttgcattgtggaagttgaaacgggagttctcgtctgcaatcgacccggtataaccgtatttaccggatacccaggaagtagatggatcatacggatttgcggtaggatccaccggatgccatctgtccataaaatagtcaagtgcattagaaaggtcgttaccccacatcggttcgcgcaattgttcgatatatcttacataactcataccggctccctgaaacagcaggttaaggtcgaaacctttataatcagcaccaacattcaaactgaagttgatcatcgggcgaccgctgtaaccgatcggatgtacgtcgtggtcagtgatctgtccgtcaccatcccaatccagataaatataatcaccgggcagtacattcttatctgcataaatcgaactgttcaggatttgatcgtatgaaccgtaacgtccgccatcgcctctaccccatttgatatcattataacggtcgttcccattgtttctccagttctcatacgagtttccggcacggccacgttcctgataagtggtttttgtacgagtgaaagagaaaatacctttcaggttgtaacccacttcaccgactctgtttctatggctaagttccacttccaccccttgagtaaagtctccattcaggttttcctgaggcagatcagcaccaacaacaccgggaagactcaagtttcttgtcgccagcaaacctgttctgtcacgggtaaagtagtcagcagaaatacctaacaagccattccatgcttccaaatcaatacccaagttcaatgttttggatatataccaggtgatatacggattggtaatacctttattttgagcaccggaaacaaaagttccgtcaaatacagtaccactcgatccctggccgtcaaaaccattacccggatacagatagccgtttacgaactgatagttagaagcacggtcgtctcccatcttaccataggaagcacgcagttttgcattgctaacgaacgatagtttggattctttccagaaactctcttcagagatacgccatcctacagaggcagaagggaagaatccccattgtccgcctgttccgaatttagaagagccatcatagcggaagctgaactctgccaggtatttagacatataatcgtatccgaacttacctaccaaacccaggttcgcttctttatataaatcgcgccttgccggatcatcaacatcataaccggtactcatgttcgcctcctgattttcactgttacccgcaaacagttggtctaaagcaagggacagttccctttgtgcaaagaaattatcgccatttctcttacttccttccaatagaatcaaaccgctgacattatgcttttcatcgaaaatacgattatagtttaacgcaacctgataaagtaacgcctctttggtgtaatgttcacgacggaacttacttgttccaacacgtggattaaccatataagtatcagaagcttcatcataagtgtactgattgtagctcttttcataaaggctattgtctgctatctgatagtcatagctgaacattactttcgctttcagtccgtcgatataaggaacatcataggttgcatcagccgaagtctggaaccatttattattgtacttcttataaccgacctggtttgcatccatcatggctacaggattgtcaccttcaatccatccgttcatcagatattccggattattgttagcatagatcggttgtgtagccggagcacgctggaaagcacggataatccagtcggaattctgatatggctgattcttctcatccataataccgctcatattcaaagagacagtcagtcggtcagtcagtttactagtaatattggagcggacattgaagcggtcgtaatccaaacttttacttttcaggaatgattcctgatacaaataacctgtactgatatagaagttgatcttttcattaccacctgtagcgttcagtgtatgttgggtttgaggtgccagcgtacgcatacaggcatcccaccaatctgttccctgcatgtcaccattacgatacgcatcaatttgttcctgcgtatatggacggacaccaccttccagattatgcatagccttttcattcttcaataccatccagtcggcagcactggcactttttggcgagccggtaggattctgccaacctacatttccggaatattccaattccaaggatccttctttacctttctttgtggtaatcaacacgacaccgtttgctgcacgtacgccatagatggcagcagaggcatctttcaggacagagagagattcaatatcatttgcgtccagacgggacatattatcacgaggcacgccatcaataatgattaacgggttacccataccacggatatcaaatgtattattgaaagaacccggttcggaagatttctgaacaacacgtacgcccggaaccttaccagtcagcatattctgcgcgttttcattctttgtcgtaatgatatcatcacttttaatggcagaaacagcaccggtcagtgttactttcttctgagtaccatatcccacaactaccacttcatccaaagcctgggtgtcttcggtcaatgtgacattgatcattgactgatttcccacaggcaactcttttgtcagatagcctatgtaagaaatcaatagagtcgtaccagtcgtcacttccaatgaatagttaccctcgatatcggtaacagtcccattagtcgtacccttcaccatcacattcgccccaataatcggctcacctgactgatccgtaaccataccagatacttttttaccctgttgtacgacaggaagcatcgcattctttgtcaatacgatatagtcattttcaaaagtgtatctgacatttgaaccgtcaaatacttctttcaggtactgcgaaacggcttttttaccggttttcacagaaatggcctcatttatattgacctcatttttactgtacacaaacagataatccgtttgtttttcaatctgatcgatcaaatttccgatcgttaaattacttccattgatattcacttgagcattttgcgaactcgtttttgccgcaaaagaagagaatacgcaaaggaaaagaaggaaggctgaaattctcataatgcttagaaatttcggttcttttttcataactttgcttcgtttacttgttaatacttaatttatttagtgttagcagcggtcgatggatgttcccgcatccatcgaccgctttttatataaaaagctcaattcgtcataggcaattactgatttaaaggttatacatatatttgactctttctatttgcttcaacgtattgtaatcttattcaactcctcatccttaacgaatgaaaaataataaatcttctgtaaagttttcaggacgctttctatgccatccctctgacggaacttaccactaaacttataattattcagattcttgttccttatttctattgtaatatcataataaagctccagtttttttattatctcaccgaaaggaatatcatcgaaagcataaataccttctttccataataagaaatcggtgctgctgatcttacttttcactaatcttccgtctttcagttccgcataatcattcggactcatgtacatggcaaccgcttcattgtccgattgatacaatttgaccgaaccttcaatcagagctgttgtaaactcatcgtttcctttatatgcaaaaacattaaacttggttcccagtacttttatatcaagtttttccgtggaaacgacaaacgggacttcttcattacggaagacctcaaagaaagcttctccatccaattccacctttcgttccgtaccggaaaaccgattgggataacgcaaccgggaacgagcattcagccataccactgtaccatcatgcaattttacctgggcacgttgtccgggaggagtcgaaaactcttcgaaagcaagctgttcttcgactgcattatcgtgccgattgttcattattgcccaagttgaaatgacagccatacagatagcagccgcatatcctaccagatgcctgatcagaccagcgaacttctttttctctcttttatgagcttctttgaattgtataagtttaccgacagctttcacctcatcgtcttctacgggtaatgaagccgataaagcacacaggttctgcataaacacgaactccttatgcaattccttatctgtttgcatcaaagaaaatagctctgctttttcctctgccgttatatccttattgaaatatttagtaattaaactatgcattttccgacttttataagggagagcgtttaagaatttatttccccccaaagccacctaaggaataaatattatttaacaaatatgagaaagagtaataaaggtaggtagtctttcagttcaattttcagtttcttcaaggcgatggtcatttggttctcaaccgtgctgacggagatgtccagttcttcggctatttcacggtttttctttccttcaatacggcttttcaaaaagatttcacggcaacgttcaggcaatttgttgattgcatccgtcaatatccgttcgatatcctcctcagaggttaaggtataattcaatgattcgagagaagataatttcgccttaaattcctgttggtattcttttacgaccaaacgatgccttaagtagtctaaacatctatttttcaccaaactaaaaagataagaaatcaggcttatacgaatatccaacacatcccgtttttcccataacaacaggaatacatcctgtacaatattttctgcatcttcgtcaaacagaacatattccttagcaaaacgatacatacgaaaataatatgtcacataaatctggtcgaaattacttcgtatactcggagctaacgtatttgtgttgtttaacggcatcttgtacaatcttgattatattattatatctgtcatttgcataaaacgagtgcagcaaagatataaaagatactttcataataagaatgtttatttaaaagatttcatttattgaaattgatgttaatattttacagatctacatttatgcctttacaacgttcgtgattaacactgtttcacgctcttacaagggataaaaacgcctttgaaaaaaagatatagcttttaaaaacaaaagacaggacttttgatgacaaaagtcctgtctttacatttcaaaacaccggtctttttttagacagatgtccgaaggggtatccggttctattccgggacttaccaggaaagctttataaacttattttcccagggagcgaatgtcgcttcggaagttcctttcaccgggtctcctactacatcgcaaacggttactgcggtaaacttcaccttatcggaagtgacggcaaacgttgccggcttgcctgctatttcacgcaactggagcatgactgcattttcgccttccacaggtttcatatttaccaatagaatattatcgggaacgatattgaatacggaggccggagaaatcgctttgttacctttcgcacctgccggtaatacgcgggtcaggaacgggatacggttctcccaggcaaaacgggtggcataacctaccgagttgtctttacttgaattgataaagtagctccattgcaattcacccatctggtcggcgttgaagttggtcacccaatagttgttcatcggccaggaatacatattggtggattggggaacggcacctgcttcataccgtccggtattgatggcaccgaactgcatcagaggtatctccggacttcccataacgacctgcgactcgttgttacgtgctgttgcaaagttctgaacggtataccagtcgttcgatgatccggggatctgatcgacaccagcttcgatggtaccaccgggcacgtcgagcatgatcttaccctggttcacttcaaacgggaaggagatatagaccgcttccggatcggtaaccgctttcttacgcaaacggtaaacgatctcgatcttcttatcgacattgaacacacggaactccaccatcaggttgttcggttcgcgtccggcaacagtttctccacggaaacggaaggtatcccagatagcccccttctcgtaacgttcgaaacggatacgttcgggacgacgacgcaggaactgaggttcacggtattgttccatcggatgacggctatcgatgatctcatagataaactcacccatctcccattcggcattcggggtggtcagctctttattcagctctttgtcgaacaatttactgatggttcctttacgaggattgaagtcgatggcataccagttgttttccacatgcgccttttccaaggaggcagaagatacaatctccggacgaggctcgtcttttaccttgatatagtattgcgcatatcccaaagcaggaacatcttttacgaacaaagaccagtaagttccatcggaacggctttctgccggctgtgccgggataacattaccggcggcatctgttatttcgaatgctttctcgcggggtaatatctgatggtcgatgtagactttggcaatgccgctatacgtccagttcaatgtattgaaaacggcaacagacggatattcggctttcggcacgaaagactgcagcaatcccatcgtcacctctcccagcaggccggaatggcggtaagcttcccaggcatacgattgtttcagggaacgttgctcccaagtttccttgcaataagcatcacgtacgctttcgctgtaaccgaaggtatgttcgtcataaaagagcaaggctttgttgatatcgtcaatctggttatctacctgagccggtagtttcgctcccagcataccggcaaacgaaaggcctgcctgattggcgatgatgtccgaatgggtgatacgggaaatagccgcttcacgtgctccggaaccaaaaccgtcggtccaccagtcgggccatgcgccacggatggtctgtatcttatcggcatagttcgattctacctctttgataaactcgctggctacagctgtacggagtttaggccattcgtatttctcgttccatttcatcagcatctcgcaactctttgtcgaagggggtgagttgtccgtgaaataaccggagtgctgggcggcaacgatgtcgtacggatagtttttcgcttccatctctcccagataattcagtacacgttcctcaaactgttcgaagttatcggtatggacgccgaagaagttaccctggttataatgttcggcacgataagtcaataccttctttcccgaaggagactgccaccagaagacggtcgggatatcgaaacagatcagggcacggtggccgtgtgttcccatattgacatacttcacaccggcatcggcaaagaactcgctgaaacaccagccgataccgttcacatcgttttgcatggcgacttccgccttcaaaccggcatcgcggaattgcttcaggggatacagggaagcggccaaagtctgttcgtccggcagttcgtcgaaatttagatacatggcagccaattcgatacgtccttcctttacacgttgtttcaggcgggcgatctgttcagcgggacggcatttgaggtattcgctgacagcccaggcgatctcgcaagtccagcggaacttggcgaagtccgggttattgtcggttgcatcgcaatagtcgagcgcatagtcgatgtagcggaggtgttccgccagaatctcggtttgcgaacgggtatagccgatatccgtatgggtatgctgtaccatattcatctgccaatgacggacaggtttcacatttaccagagcagactctttttcttttccaaccgttaccgtcagaggcagttgcacggcagactgcacagccggtatctcaaaaaagaactggttagtaccgtcgttcagtttttccttccgcgactgattccccaacgtaagtgttgcagaaacaggcgcaccgctatgcttcacggttacccgtactttctgcaccgggcctttcaccgttttgtataaggcagggaacaggtgggtttcgatcgccggaggtgctgtcgaagcactccatacggaggacgacatagcgaacaatgccaatcctgccagaaacaaggtttttaatgttttcataagcatctattttttatcgattccaaaagagataagacaaatataaaagatacaaagcaggaggatggataatccggcaacctgcccgaaaccgtcggccacgatccccatcagcggagtgatcagcgcaccgccggatacccccatgatcatcagggccgatatttcgttcgcccgctccggtttatgctgaagggcaaacgagaagatgatcgagaagacattcgcacaagccagccccacgataacgatcatcacgaacatgctccatgtagcagggacagccagcaacaggataaatgccacgatggcgacaaacatgctgtatttcaggaaacggcttgccgaaacttttgccagcaggaaagcaccggcaaacgaaccgatcgtacgggcggcaaaatacaagctggttcccaatccggcttcggaaagagccatgccggtacggtccatcaggagcttgggaatggttgtgttcagaccgacatctataccgactataaagagaatccccaggaacagggaggtaatgtatttatcgctgaaaagggatagcgtcgtgccaaaagtagccttcgcctcttccagtttttcttttcccggaatggtagagatcagccagacggtagagacaagtgtcgtcgctgcatagacagcaaagatcagtttccagtcaccccagaaagaggcggctgctcccgctatgatcggtcccaggaaagaagagatggccttgatgaactgccccagagtcaggacactggtgattcgatcagggttgacgacattggcaaccatcgggttcaacgaaacctgaaggattgtattaccgatacccagcaaagcaaaagccaataggactgaaacaaaatcgtaaagaaacaggggcagcaacatagccagggtagtcacgctcaacgctatcacaacggtattgcgccgcccggctttccccatcaggatacctgtcgggatcgagaacagggcaaaccagaggaacaccatcatcgggatcaggttggccattgtgtcggacaagccaaaatcgactttcacatagtttgtcgcaatgcctacgacatccacaaagcccatcacaaagaatccgaagaggatggggtaaatggcttttgaattttgtttattcataattcatgttattaatcaaagttattttatagcaaaatacaaccaaaacaaatattacctaccgtctcacagtgagaatcctccaaaatcagacagcgaagcaagaaaactgtgagaaaactaaaaaaacggccggaggaacattcttacagtttttctgctttcaataagtatctgttgcctgattgcccatatccatttccaggcggcctccggcggtgattgtttcaaaaggaatacgagtggcaggatatatctcgccattcaggcggtattgctgcacataaacgttttctttactgttgttctttgcttcgataacgaactcttttcctttataatattggttgttgagccgaatggttatcttgtcaaataccggactgcccaaagcaaaagacggtgttgcgtccgtcaagcctttcacgtcgaacattcccagcgaagcgatcacataccaggcacctaactggccctgatcttcatcctgtccgtagccgtagccatgaatcccgtccgtaccatagaactcatcgaggatggcacgtacccatttctgggtgagcgaaggacgaccggcttcattgaacagccaggagatatgcaggcaaggctggttaccatggttatacagggtttgcaggccggcaaaggcaccaacttccgtaccaccgctaaatatcagtttctgagaaaccgtgaagatactatccagacgttgattgaaaacatccgcaccgaccttgccgaccagtccctgagcatcatgcggcacatagaaggtgtactgccaggcgttgccttcctgaaatccgcgccagacctgcatcgggttgaagtcttcaagaaactgtccgtcggccttcttgggacgtacgaaattagtcgaagggtcgtagatacgttcccagcccttggataaccacatcagtttatcgtaatcttccgtcttaccgagtttctttgcccattgggctacggcccaggcgctataagagtactccagggtatgggaagcagagaacataaacgcttcgtccggtccatcgcctttatccagatggggtacataaccatattcgacgaacttatccgtatcggtctttccggctcccaaaggacggttgttgccatccagttcattcttgagggatgcttcataagccaggtctacgtcaaagtcgcggataccgcattggtaagcgcctgccaggatcgtactcagcaggttcgtgccgacacccgatacgtaacggctgttggcaataccgtctgccaaccagccggcatctttatagaccaataaatggctgctgatgtaatcggaagcatattcgggataagccagtgtccacacctgcgaaagattccactgggctccccaggcggcatccgtattatagaaattatggacaggcttgccatccttctgttggatccggcctaccgaaccatcatggcggggataggcgccattcacatcgttcaccagtccgcgtcccagcagagcatgatacagaccggtatagaatttcactttatcctcttttacgggtgtctctacccggatacgtccgagatagttttcccattgttgcgcggaagccgcggcggcctggtcgaaagtaagcgtgcgggcctccgtctcccggttcaaacgggcattctcgacagaggtgtacgagaggccgaccttagcggtgatagtttccccttcccctgttttataggtcagatatagacctgcgccggggccggacacctgttttgctcccgcctgtaccgtttcaccgataaaggttccgcaagcttccggttgcttgtccaactctgcggagaagaacatggaaacggttgctcccggctggtatttctttacatactccggcaaggtaaccacccagccttccacggttccgtcgtcgttgagtgccacgaaagcatctttcacatgaccgctttccccctgctgatggcctatatcgaaaaggatacggctttcgtcgccggcaggaaaggtgtaacgctgaaaggcgacacgcggggtagccgtcatttcagctttgatgtgatagtctttcagaagaacggagtagtaaccggcagtagccacctcatccgaatgctcgtaggcggagcggtaaccgacccctgtcgagtcgccgacagggccggcaattgttttcaacggcccgtttgtcggcatcaggacaatgccgcccacctgaaattcatgcaggcagggaaaaccttcgatggaagtatcgcgatagtcgtagcccgtagcttcccaaccggagttgttacccaagtgtccgttggtagaagggcccggctttgccataccaaagggcatcgcaccgggagcaaaatggaaccagcggcagtgagccgttccgatacgcggctctacatattgggataagttctccggggttgcttcctctttcaccggcgaacagctgacagccagcaagccggtcagcagacccagaaccggagtaaatagattatgtttattcatggcgtatttgtttataaatgatttaatgcatacacataagcaccgagagccaccgaacgacttgccccctgcttgctgacaatcacaccgatccgtttaaacggatcataattgacagtacggtcggaaccgggaacagcgatcttcacggccgctcctttggcgaactgctcgaactctgccgcgtcatccagattgaatgctttactttgcaggcggctgaaacggctaccgttcatcatccccgtttcgctgttcatttcctccaaaagagacggcatgaaatacttcgcggctccggtcaggcctccgccaataacgatcagtccgtcgatcagcgtaatcgcttgcgccagggcatcaccggccatttcgcccagttcggcaaaggcagcgcgggcagcttcccggttacccggatgcgtaccttcggctatatcgaagatctctttgggagtgaagggagaagcttcgcccgacaatagccggtagatatgttgcacggcacggatgctgacactttcttccacaatatactgttggtatttcttattgcggaagcaccagatatcgcccccggcggcattgtcaccgaccagcagatcaccgttcagtacgacacccgctccaaaacctgtacccagcgtgacaccgagcaggttcttatagcgtttgatacttccggcctcttccaggcggcggttgatctcgggcaaggcgccggtcagcgcttcgccataagcaaataagtctccatcgttattgatgaagacagggatgccgaacttttcttccaggtaagggcccagggccactcctccacggaaagaaggaaagttcggcaggtcgccgataatcccggcgggatagtcggccggaccgggaaaggcaaaactgatcgctaccggggcttccggcagctgctcacaaacacgggtaaagccggtcaggagctgccccaggcattgatccaagtggcaggcacaggagggcaaggtgataggtgtcactatctcctcgccaccccggatggcagagaagaccaggttggttcctccggcgtcgagggtcattactattcggttatcgttactatacattatatatatatgtgttttaattgatatttgattcttgtcagatttgcatgttgcacatttttctaattcacccttttgtcctcacatacgcctttatcgttccacagttctttccttcggaaataccatatgggcgaatcgtataatcgccgacgatggcaggaacgataaacgtttcggcataatggacaatgaaaggctcgaacgcattcgtcggactttctacgatcaactcgtcaccttccactacattcagaacgttgacacccccacccgtattgtgcggcacctttccggtaaaccaatggcgacgggtttcgataaactcattttcatgcaagccggtacgttcttcacgccagtcttctccctcggcacggggttcgaaatggttgaccagctggtcgcgtacgaactcggtttgccgttcccactggatcacgtgagagccgtgagcgatattgatagggcgtggttttccgtccagtcccagtcgatcccagtcccagagtttgaaagtaaagatactcggtgtggcactgatctccagaaccatcgcttcggagccggagcagtggatcgttccggccggtatcaggaaatgatcgtgcttcttagcaggccatttgttgacatatttatcggtatcgaaagtggtacccgactcctgcgcttcattcaaggcagcaatcatttcatcaggatcgacaccgtccttcaaaccgaggtagacggtggcaccttcaccggcatctagcaggtaatagctttcgtcctgggtataatagataccgaatgtatcacgtatatattgcgtcgtaggatgtacctgcaaactcagattaccccctcccatcgtatcgagaaaatcgaaacggatcggaaagtcctgtccgaagcgtgcttctaccggcgctcccagtaagttacgggtctgatagaacacgaggttgtttgaagccatttcgaacagctccccttctactttcagataaagactgttctcttccggcacacagtcgaaacaccagccgaaattatcccggctcttatccaggtcgcatacttctttcatccactgtccaccccagggagccgggtcgaagaagggaaccacgcggaaaggacgatgagccgtcttttccagtccggcacgcattgtttcgccggttatcattttaggcattccggggatatgggtatccagccagtaatccaccttcggaagtaaccgtttctttaattcatcacatacattccaatcgataaaataaccacgtttgtaatgcagggaaggagcttcttcccggttcttcacgcccagcccgtcgatttccttacgacggaaacgttgctgtatctcccagcgtgccatatcggcatagataagaatatccggctcggccaccaactcggcagcaccaggtccccagacaataaccaatccgcttgccgcatatatctccttgcggcactcctccatccgggtttcatccaggaagtcgggataacggaaagctgcccggcgaccgaaaaggcggtcgtccgtcagataaggataggtcatcgtttcgatctcttctacgcctttgaagaatttctccgaatgaattatcagtgaaggccgcaatgctgccaggtgtttagctagctcttccggatgtataccctgatagcattctacaacaacgactctatgcgccaactcagggccgttgcacacttccttcaacttatctaaaacagactcccagcctttccagagcctgcccccgacggttgtcgagggagttttatcataattactctttctcattatcttatttattttcttctgaccattcattaaacatctcgatagcttttgccagtacccctgccgatcctttgaaatgaccggaaccgctgggtacaccacccatgccgtaccattcgtagaaacccttgtttttgatcacccggtcgatcataggacgtacttcttcataagcttcctttaccataccgttggctataagctgctgtatcatacgaccgccgaaccaggtccagtcgccaccattctgatagatataggctttcgacattcctccacggaaaaagttttccggataagtgggatatagggttaagccgatactcggcatacctgacaggcggacgttctcgagcatctgtgcattgacggttgcaatttcttccggtgataaaagtccggcttcgatagcaatggctgttcctccgtgatagtgcacgtccaattcattgaaaccttcgggtatcggagatttttcgggatagatatgtggaatgaacttctgacgttgcgcatcccagaggtgcttacgtacattgtcggcaatatgctggcggagttctttccaacggagcttatcggcttcatcggtagttatctcgtccatatagttgagagcgatgatgaacatggcattatcatatacgtcgatggccggatctgacagttcgttcatatcacaaccgaagtcgtcgttgggctgtacgtctccccagtctgccgtcatagcaccatagagaaggccgtattgctcgttataccgttctttcatcagatagtcgatcattccgaccatgcgttggtagacggtacgaccggcaaccgtttcattcagaatagaggtgtctccggtcttgcgtatatactttcctacgatatggatcaatgaggattcctgatcggtttcgaccgtattcttgaatgcgacatggtcgggcgctgcctccgaataatacgggtggtcatcaccccaggtgaagtcagtctttaacacgtagccgtcgatcatttcatcgttgggttgctgaagggcaaagaaaagaaggatagcgttacgaaggtcggcagggttgctttcctcacaggctacttctataaatgtgttcatatcgcgtgcccatatctgggagtaaccgcttccggcattgaaaccgctacgtatcacggcacgggccatactgtcgactacatgtagtgtattgtcgttacggatttcttttgctaattgttgcgtgggagtggggcctgcacaggcgataaaaccgctgcacagggtcattagtaacaagtgtttctttttcatattatttgtattcttatttggtgcaaagatattctattgctaaggattaaatgctttcatttattgcgaaagtcttatactatcttactataaataaaaaaggtgaaagttaacctttgccggaatgtttggctaaggttaactttcacctttctatttatataccggatcagaaaatgatctctatctttccgtaacagggagtagcttcaagagttttacaatagttaccccaagctatttcagggtagtcccagcggttattcacatagaggatcaactggccgtcggctcgtttattggagcggcaggctacggacgcatcgggggagataacggacagtccgtctccggtagctggcgaaagggtgtagaagtagatgttttccttcatgcctttggctttccgggtgagcggacggtcacagttggctccggcgtcggcccaataatagtagtcgtgggtatcatcggcccagggttgatcgggacgggctccataggctactttattaggattgtaaagggaggtgctgccttcgttacctgcaaattcaccggccgggtaataactccagtggcctttacgtttccatgacaattgatctattgtttcgggcaggtagaacgagagaccggtttcacgcaggaagccgttaggttgcccgtcagtcaggtagttgatttccattttcccctccgacgagataaggatacggatgtcggtacggacgttccggtaactgcctgttaaagagacaaggatgttgctgccgcgcttttcacaggtgatattttccttcttccagtctgcctccgaagtaatgaacttggttgcgctcttgcgtacttcggctccggtcagatggttcagattgatgtcgagattcaggaaggggcctttttcgataagggtcttaccgtcgacggtggcgttgtcgatcagtccggtttccttgctgaaggggatttcaaagccgttacctttcaccacgaagcgatcggaggtttcttccagctgaagtgctcccttatgagttggctgcggaagagcaactaccggctgtccgagcgtaacaagaaaggcatcgataagttcgttgtcggcatcaaggaagctgacaagtaaatcgctacctgctttccagtcttccgacgggatgaccagaaggcctttctgatgcggttcgacgacaggagatacggcttctttctctacaccattattatatgtatagcggacttttacttcattgaggttcgtatggtcaaaacggttgtagactggaaggatcaaacgttctccggtggtaaagtcgctaacctgtcccgttaacagacggatgggcgaataggctttcttggtagaccaaaactccggtttctcccggcgccatacatctacaattccccattcaccgtaacctacacagtttccctgataatcttcgggtttggcggtacgggcaaattctttccagaaggaagtaccctttttaggctcgggcaacataaatgtttcgtcgatatatccccagatagcaccgcccagaccaccgggagcatcgaacaggccgctccacatcttatcgagggagataccccagaactcgcggatattcggatcgtcctgcaatgttttataggtataacaagccggatgtgcccattcgtcgaacagagccgggataccatgtccctggaagttacgggtggcacgtccccactggttcagatttccatccacatcctgataatgcatgctcagaatatcatatataggcttcttctcgcctaccgaccccggataactgaagataacggggcgagtcgtatcggttgccttcacccagtcccaacagagctggaagttcttgccgtagacactttcgttgccgatcgaccagaaaaggatggacgggtgtgaacggaacgactttaccatctcacggcattgggaaagatagcggggggtaaactcggcactgtcttgtgtcttacccggagcatagttcttctgacgataggtatcgacaaaacaaacagccgtttcgcactctacgtagataccgaaccggtcgcaatactcgaggaacttttcagaagggggatagtgcgaagtacgcacgaagttcatattcgattgtttaaaacggatggcatcgagactgtcgagttcggcagtcgtggtacgtcccagcgtgggatggatatcgtggcggcaggctccacgtaatttaacgggaaggccgtttacaagcatacggtcttttactatcttcacatcacggaaaccgatccgtttactgaaacgggtcagttccttgcctccctcccggatggatacggccagggtataaaggttcggatgttcggcatcccatttcaagggattgcgtacggacagctcgttgctatttccgttttccttcaacgggaaagttgcttgcggcaatgaaacgttgcggcccgaaggatcagtcagcgtgtaagccacttcggcattaccggatgttttaccctgataagaaactttcagtacggcatctttataaagagtgtcgagatgagtttcggccgagaaatcgtaaagacaggtttccggtaaggcaaaaaccgtaacgtcgcgcaaaataccgccgatcggatgatgtccgtagccggaagcataagaaatatcatcgatacggtcggtgatctccagctgtatctcatttttctttccgggatgtacaaacccggtaacatcggtttcccaacgggtgaaaccgccatgatgttcgcgaacctccttgccgtttacccaaaggcgcgcatgactgtaaacgccgtcgaaacgaagtatcgtacgtttccctttataatcggctggaagagtgaacgatttacgatacagataaggtgtatcatgtttaatggcgtagccttgcatagccagttcgccgggaacctgtacgttactccactttcctttgtcatcgtaacggaactgccatgtaccgctcaataatatcgaagagttgttcaccccgcttatctcgcaagggatcaggtaagccgactccggagacaatgtcccggaagtatcggccgccaataaaccctgccccataaacagacaggcactaagaagaaatgtcttattcatatgtatgttgttttaattattaccaccagaaccaatagaatgctatcaatatagctatcacgatcagtgacatgatattgaacatgcgactcgtatggaacaaccccggccggtgcgtcgtataaacattctccatcggcttgcgactacccagcaggacaatcaatccacaacagaggaagaagacgatcatcatacgatccatccacggcaaaccgggacagagaaacttcatcaaggtagagaatacaaacgatccgaaagcagccgccagcgccccgtttgccgtagctcgtttatagaagaacccggccaggaagatagacaaggcacccggactgataaatcctgtaaattcctgaatatactggaaagcctgatccagtcccgacaacatcggagcgatcaatacggcaaccagcagcgacaggaaactagcccatcttccggtcttcaccagctcatgctgtccggcttccttacggaaaaaagacttataaatgtccatcgtaaagatcgtagatatactgttcatcatcgaagccagcgaactgacaatcgctgccgtcagcgccgcaaaagcgacacccttcacgcctaccggaagcaggttgctgagcagccagggataagcctcatccgacttttccagcggagcattcaatgcaaaggctgcaattccgggaataactaccagcaacggtaccagcagtttgataaatccggcgaacagcatcccgttctgcgcctctcctaccgacttggcagccagggcacgttgaataatatattggttacatccccagtaatagaggtttgccacccacagtcccccgataataacagaaataccgggcaggtctttgtaactcggatgcgacttatcaaggatcagatggaacttatctccagcctgtgcatacaggttcgtgacgccttgccacactccttcaccggctcccagcaagtctaaagcaatataggtcgttatcaatccgcctccaataaggaagataacctggaccacatcagtcaaagctaccgccttcaaacctccgtagatagagtatatgccggcaaaagcagccagcccgaccacaccccaaaacagcgggacacccatcaccttttcgatggtaagtgctccaagatagagaatcgaagtcaggttgataaagataaagacagccagccagaagatagccatgaccgtttttacccgtttatcgaaacgttcttccagaaactgcggcatcgtgaatatcttcttctccagaaagatcggtataaagtatttggcaacgatgatcaaccccaatgcggcaatccattcataagtagccattgccagcccgatcgcatatccggaaccggacataccgacaaattgttcggcagagatgtttgacgcgatgatcgaagcaccgatcgcccaccaggcaagtccgcgtccggcaaggaaataatcgccggcatcccgttcttctccctttttctttcgtgagacaaacagtccgacaaaaagaatcaaggcgcagtaagcaataaaaacaatcagatctattgtgttcatggtattaatattcgttatctaattattttgccatgcctttggcaaaacactgccattacagtggcaaagctctgccaaaggcatggcagagttctgccacaagtatggcaaaaccctattcatcttgcatcagagccgaccggccgccgtccatcaggatcgttgtcccactaatgaaacgtgccataggcgatgcaagatagacacagagatcacccacttcctctactgtcccgatccgtttgaccggatgcagattgatcgtacgttgccgttcctcccgggcatccgggaaagagtcgaaccaagtatcgttgcctgccgtatcgatgaagcccggagcgacaccaaccgtacggatagccggtccccattcgatcgccaggttacgaaccaggccggtgatcgctgtttttgtcacactatacggaaagcatccgggaatcgttccgaaagcatgattggaggtcatcagcaggataacaccttccccactctgctccaggtagggcttgcataacttcgataaacgccaatgggatgccaggttcaaatcaaggttatactgccagcgttcttccgtacatcctcccgccccttcaaagacattcattcctgcactggaaaccagaatatccaaccgtccgaaagtacgtatcgtttcctccaccagttgctccaattgttcgggacaagtcacatcggtctgcacatacagcgcccggactccctgtgattcgacagcctcccggaaagcgaccgccgattgatcctccgccgcttttcgagcacatccggcaacatgagctcctgcccgggcaaactctcgggcagtacccagaccgataccggatgatacgccggtaacaagcactactttatctttataatctattgtaaaactcatatgcttaaatatagaagttttcaggagcgttcgttgttatacccggatgtttttccatctcttcttctacgagatccactcccagaccgggacggtcggataagtgcagatgaccgtcgtacaccatctcagcgatcggatgatcgatcaccgtatctctccagggaacatcattgaacataaattcctgacggaagaaattaggaattgcagcacacacatgtgaagaagcaagcgtcgataaaggcccgttcgggttatggggagcgatcaggacgttgtaggcctctgccatcgttgccatccgcttcatttcagacggtccgccgcaacgggtaatgtccggcatgatgacatcgcacacgtgtttttccaacaaagaacggataccgaagcgggtataatggcgttcccctacgcagatagcgacatcggaagggatacgttcacgcatggcacgcaaggtctgcgaactttccggtccggcaggttcctcataccaggtaatatccagcttcgccagacgttcggccatcttcaccgccacccggtaattcagcatggcatgcgtctcgatcataatatcgaactccggtcccaccgcatcacgtaccgccttcgatacgtcgaaagccaggtcttgttgttctgccgtcagagtcagattggaagccaggtcttccccgtagaaatagttcgtatgtgcgaacgggtcgaacttcagtccggtaaaaccggcttcttttacccgtaatgcttgttcagtataatcttttgcattatgtccgccaccggtaaaccagtagttcgcatacaataatatatctttccggtaagcaccgcccaacaattcatagcaggggacacccatcacttttgccttcaggtcgagcaaagccatgtcgataccgctgatagcacataagctggcaccgtacggaccgatccagttaagatcgcgatagagcttcgtccagataaaatccgtcttcatcggatcaaggccgatgatgcgctgccctacatgtttggctgcttcgaaaacgatcgggcttcccggccagtttgtagcttcacctactccggtatacccttcatccgtatatattttgagtaacgtccaattgtatttgataccttgtaccaaccatactttaacatctgtgattttcattgtctatctgattttattacatgattccaaactgatcgaaggcatcgcgagccttcattccttcctgtatcttctttaataccatccgttcgccacgggctttttccaatgcgcgggtaaagacttcctcttcgatgctgcgcggaacaacgcatacgccgtctatatctcctatcagcatatcgccatcgttaatacgcacaccatccatttcgataggcacgcgataatctatcacctttcctctcggtgcctggtcttgtgcataaggtccgtaagagaagcaagggaagtcgagtgctaggattcctttcgtatcgcgtgaataaccattcaccacagcaccggctgctttgcactgcatagcccgggcactcatcaactcgccccacaaggcgtaacagggagacgaaccggaacaaacatagacttcatcttctttcagatcatccaacgcttcgagcatcaatccgaaagaacgtttcaatagaggattctccccgcattcttttccatgttccaacacatctgcttccagcactgtcattgcacgtccgacaaccagcatgtcgtcacgaagcggacgtatctgcgggggaagaaactgacgggtatatcccatcttatccataatgtcaccgatcactgcggtataaagctcttcttttatcaaagagaacagggctttatcatctttccattctttcatttttactatagtttatcagtattcatatattccattctactgatcacaaagttagccggagtatacaaaaagggaataggaaaaccgatcttcaatgtatgcaagtaggaccttttaaggggaaaaagtgtacaaaacggaaaactatttcgtaacctccctcggagtaattcccatctgctgtttaaaaactctcgaaaaatactgaggtgatttaaaaccgcaggtgaaacaaacctccttgatcgacatttctgtattacgcaacaattcgatcgccttattgatccgtatctgattcagataatccaatggagacaaattgagatactgagcaaacagtttacgcaagtagcgctcccctattccggtctgcccggccacatcgctgatcgtcacttccgactgataattcatacgaatataagaaattgcctttttcagcgattcgtttgtacatatcggcagataggattcatccatatagcggtagattagaataagcagttccgcataatacattaccaccagatattgatagtatttatttttcagattcatctcgttgacgatacgctgaacggcccgcatgatacgaacattgtttacgatcttgatcaggcggttttcctccgagaagatagtaacgggagtcaactcgcctgtctcatcctgtgcatgcggattgaaacgggagaatatttccggcagaaattccaattgcatcagtgtagtgccttccgaaccggcttcgaaggtatgctccacattcgagcagacgatcatcatctcgttctcattgaagctgatactttcgttttcgaggtgcagaatacaattacccttcttcacatagttgatctcgatacgcaaatgctggtgtggtccgaatgtttcaaacggctgaaaagagacaaagcgaaatacatccgccagccgtttatgtttcaggttgtccgttatcccttccaggagtccccagagggattgttctgttgtattactcatagtattctctttttctacatgtatggaacaaagatatggaaaaagagagagccgatttttacactttcaagaaaaaagaagggccgaaatggtatcattcggccctttaacttatacaaaacggtattacctaatttactcttttatttttccagtaaaatgatcatgccgccccgtcccataatctcacactgggtcagggaagacatcttaccttcccattgtgtgtttctgatttccggcaaaagataggaagacggcttaaagcccagtaactgttcgtccagggaaatctttgccgtttggggaagatcagtccagttagccagtacgacaagcgctttatctccgttgatgtaaacggtagccggaatattcgcattatccgtttttaccggacaacgttcgtcccaatagcctctcatcacggcatccttcataccgaaatcatcccaaagatgccagagcggaacaggattcccgctccacggcaggcggggaagcataccgtagatcattccacggaacacattccgggcatctaacgtttcactcatcaatccgaaaggaataccggacatttccaccagccagaaatccaatgtattatttgcagggaagccttcaccgatccaggtacggtctacgtaaggcagcaactccagataaagatgcagcgaattggcatagccggcccactggttcatgtgattccaggaatggatatcgatcaggcggcgtttgccgtcggcatccattacacggcgggcacgttgcagcgtttgatgatccaaagcactgtcgtcgatatagacaccatccagtcccaggttctttatcatccagtccaggcctgccagatagtaattgttccaacgggaatcaggggttgttatgaccgagatatccatatcgccagcatatttgccttctttaaaagcgttataccaggccgggatgaaatgagtcgtcaggtttttgttcaaccattcgtgagggccattgcgatggatcaatgtacgggcatcctttccgggaccgtcatggatcacttcactgcccaggctacgcaacgcccataactcaggtatcttcaccgtcaactcacgggtcgtataataaagccggacatccaaatccttactgtgtgcatccgagataaaacgcttcagatccggaacggcttcatcataatacgggtagttaatgaacggataaatatctttcttatgatgtacattgatcatgttggctcccgcttccaaagcggcagggatataaccggcactcacgtcgctgttggaatggaagaaacgcttctcggcgagttccggcaggttaagcggtttcaccggagtaaccagcatattgaaattataatgaaggacatcgcctttcttcatatcgcgttcaccgctgtaggctgtcatcagaactgtaccatctttgccgggcagaatgtcgataccgcctttattcgcatttccccacgaagctggcaggttcaatttacctaatccataataaatatttaccaaaggacggttatagttttcatctttaaagcagaagttcagaccagcatttatatttcccatccagatcttatcctgatgtttctccacgttccattgccagttgatcaccgaatccggacgcaaaccgcctttatggcctaagcccatcatatatttggcggcataagcagtgtaaggcacttccagacggatatccttcacctttacgtctcccagggattttacctgtatccgataatcgaccagcccatcaaagccgaaacttccggaacactgtacttcgaaatgacggctcttacggccggccgtccaatttaccaatgcattattccgtccggtgattcgcagcgaaccactcttcaatacttcttcgccattctccgtttcgatcacgaaccgcatttcactggccaaaacagggttattgctctggtcgttcaattggttgccctgatcataatgggtagaaagggattgaggcaacccttctttcgacaactccatcgtcccacccagccaagagatcgtttgcttccgtaattgaaccggaatatacggagccgtgggctcatcggcatttccgatggaagaatccagccagcgaaggcgggttttacgccaaccttcattatctccgtggtttgcaatgggagaaccttgcacggtcaattcgcaggcgatctctaccggtttggcattggcagctttgactgtaaccgtccctttataaacaccgcttgccgtcacaggcacatcggaaccgatccataacgcctgcacatttcctttaggaacatttaccgtctttttaaaagtcctaccgttcgtatcggttcctcccaggttaaagcaacggaaagcggaagccggtatcttattccctttttcattcttccagtcagaaaaggtgacggacaggttcgacatgtccttatacggagcaaagattcctacctgccaggtatagaactcgcccggaagacaatcacccctgaattttgtccgtgaatcggccgtccgctccacccagcgcaaaggtatcgcatccgtcatacggatatcgtgctcccggtcttccgtaaaacaaaaataaccggctaccggattttcctgtatcaacttcttcactgcatccggtgaggctacaaggcgcatttccgagtcttgctcgtttaccgtcccctgtcttttcaaatcgtcgaaagcattcgttacatcatcctgcgcctgcataacacaaggcagggtcagaagcgaatataccatcaggtacttaatttgttttctcaacattgtagtattcttttgctaattgtttgtatttgtctaacatctgacgggcaataacgacttcgtctccttccgttatcggagtacgggctttacccgaacgattgacgaaagccaattcccagtcagccaacgaatcataaaactcattcgcacggaaagcctggcgacctaaatccatctttgcatcttcctccctataagtcgttccattatcaagatgtccctgcaacatatcatagaactgtttccagcgttgcagataatacccctcgatcaaaccggtccattcgcgccatgaataatcgaactgacgaacatcgacctgtcccccccagatagtcaccagtgaagaggcattcttttcaaacaaattttgttcttcatcagttgttccccaagcacgggcatccgtcaaccactggtcaaagttaaactctgtacgcgtacgaagcaagatatctacatcttttaataactcaaggaagcgtctggagtgtaatgcaaacgcctctttatcctttttcctgaatgcttcggctgcttttttatgtatttcctgccccaggttagacatgacctgacgctgtacatctacaatatcgaaacgataaggtttggaacctttcaattgttccgcatcctgcaatagacaggcttcggcctctatcaacgattgcggatcgtaaggaatattaaaacctgcattcggtcccgactttttcacatccacagcaggacgggcacagatgatcgaactggactcgaccccgttcgtcccggcgcaataagggcctgccaataataattcccaggctttgcaggcagcatccgaaaaagctccatagcgacgttccgcatatttacccagccattctttcagcttcaccgaatcttgatgaaccggcatttcaaaggccaattcataaaacaccggattctgtccgatcgactccatgaacaaaccggatcccaccacattcggcgtttcctgctttgctttcataaactgattggatgataccagcggcagatctccgtgaagattgacacgtccgccgaagttatggaggttaccagctacaaaatcatggccacagaaatgatcatctccccctaacgctccgttcaggctcaatacaagcaggtcatgtttcggtacgacggaagcaatatctttacggaagctccaggcctgcatcacccacagcgcattcgggtcgaaagccttcatcaattgatggatagaagaacctacggcattcagatattcgggagtatccacaggcggttggctttcatgaaaaggatcagccgcatagagcccgtaagtcccatataatttctgttcttcttccagaaaggcttttcccagttccgtaaacagcgggtcgagtgggtctaactggcagataccttcaaagccgtaccaatcaggttgtttttgtatttttgcctctggaaacttctccatcatcttacgaggtacagcaccggaaaaaccttgctgcaccggtgtcattcccaattccaactgacgatttaccacttgtttacccaaagcaatatgcgaatcgatccatgattttggcagcggtccgccaaagctctcgatattaggcatccactgccaggcaaaatgggcaggatcgaccagataagaacgtgcttcctcatccgtaaaaccaaaacgaagcagtgtattataccaaacgccttccaggccgacaaccgacaaaggcgtattgatcgagttcatagccatataatcgatctcccgctgccagcgctgccaatcccaccaggcaccggtatagctcaacgtacaataattaaaatagacacgatactttccattaataatccgatgtgttgtctctgtcggaacaggcaatgtttccggtaaacttaactgatcgccgaaccaggagacatgggccttgcagtgatatttcaggtattggttataggcggttgccaacgatacggtattgttaccgcgcaacaccactttgccattctctccggccacttcatagacatcatttccgttctccggctcgatcagttccagacaaaactgtttaccatacccaggactgatacgttcgatcaggtcgtaagccgcctgtatctgcggatctttctgacaggatatgaaagataaaaaacaaaaaagcaagaatactttacttagaattttcatggtataaaactttaaattatttcttactagacgaaataaagccagtttaccctatgaattcagacaaataaacttacctagttaaggtcgaccagtttgtcgggaggggtatctccccaccatacaatttccttgcctcggcaaaataacaaacgtcgaataacaacaaatgaagttaccctatctgccggggagctggattcctcattaaatcaagcgtacaacatggcattttaatataagacataaaaaaaatgaatttagatatttcatatctatctgtaaagaaacaaaaacaaggggcttttgaattcaaaagccccttgttttatcatcaaaagtcctgtcttaacatttcaaaagacctgacctttaaaatgctcctgtctttatcttccggaatgaaaagaaatccggatcttaccttctaccttgtcccctttccgcaaaggcctgtattctttctcagcatgagggatcaggaagttttccttgcctgcattattgtagccggctaccaataaacggatggcctctccgtctatccatgaacgggtatgctgtgaaccgtcggaaatgaccgtaagtgtttctccttcctgattcttcaggtttacggagtagacattctcttttgtcgaacggaagaggttagaacctgcagccgtctgatcgagcgaccatgacaccgaaggcgattttgaaggaccggcaagaccggacaagggcaaagaagcattgaaggcttccgcttttccttccaaagcaccgatatggtcttcggggtaaacactccaatatcctttacgtttccaatccaggcgggtaaaggaagacggcaaagtaaagaccaatccggtctgtctcggtgaaacttcccggagcatcgtaaaatcgtaaatgaaatcaacttctccgttattatggaaacgatattcaaacgaaccttcagcctccttatatgctccggttactctgacactgatctccttttcccccgatgtgcaggagacggactgtgccacccagttttcacaaagcgggttaaacggagtgaacttctggtcttttcctgtcatctgaataccttcaccttcaccgttcaggggtaataccattaatgacggtgactgttgcaataggacttttccattacgatcagcagataacaagccgttacgtttatcaatcgtgaaatgtccggctaaggattccacctcgatccggtccgttttttcccggcaggaaagttttcccgtcagacgttgcatcggctgttcgcattccggcaggatgcggaagttatatcgatcgataacaaatccacgtacaccggttactgtcaactccattgtttctgcctgacgcaaagactccggcagtttcacttccagttcgccttccgaacggggagcaacaacagctgtaatcttaccggttttacctcctgctttccattcaatcgtacattcggacagattactgaaattatggcggttctctacatggaaacgaacaagtccgtcttctgtcatattccctttcaacgctatttttacgggactgtaagccttcttcatgctccagtactccggtttttcgcgacgccagccatcaaccgggccccaggttccgtaaccgacggcacgttcgcccggcaaaaagaaagtatcgtcgatacctgcccagatagctcctcccagaacgccctggctatgatacatatcgttccacatcttatccaataaaggtccccacatggttcgcagtcccggatcggcagccagctccaggcggttgtaagcattcaggtggcagaactcatcgaaggtgacgggacgtttgctgttgcgatatttatccggcccggttggtcccggatagtgatgattggttacttccagttcaccgttatccgcatccggtccccattggctgaagatacggggacgggtcggatctatttgtttgactattcccgatgcttttttgaaatattcatcatatttcaatgattcgttacccattgaccacataatgacggaaggatggctacggttcaggtttaccatttcgacatgctgattaaccaatacggcatcgtgcatttcctccggcacattcgtgttatgtgcccaacaaaaaggagcttctacttcaaccagcatacccagttcatcgcatgcttccagcaaggcctcatcgggcggataatgggaagtacgaaaataattcacatttccgcgacggaacaactccacatccttacgccacatatcatcgttcacagaacgcccgcgcaacggcataacctcatgatggcatacaccgcgaagttttaccggcatgttgttaataaacatctggttaccgcgcacttccacctggcggaaaccgacacggcgggtagtttcatgcaatacctcttttccgtcctttaaccggcaggtaaaagtatacagataaggatgttcggaatcccatttatggggatcggtaatatcaaatgacagttgcaccttttctgtatttccggctgtcatcgcaccgacagggactgtatttcgtttcaatggaatatcttttccactagcatccttcaaagtaaaagaaagagacaagcctttagccatagctggagattcattcattatctctacctctgtctttaaagttgcatccgtataggtcgaatcaaatgaagtggaaacatgaaacatacccagattcacttccggtaatgtaaacaaatagatatcgcgtgtaatacctcccaacggatgaacggcatactgagacccgctcgatgttgaatcggcaaggctctccgatattactgaaaccgctattctattttctttacctgtttccaccagatttgtcacatccagttcgaaagcagtaaaacctcccaaatgagaaccggcctttttgccatttataaaaacctggctatcactatatatcccgttacaacgtagttttatccgttgtccggcccaggaagcaggaactgtaaacgtacggaaataaccggccgcttttcctttttctacttcaaaaccttgcatgacccactcgccgggaacttcgatattcttccagttattcactttcgctttctcccaaaagttcttttccggagaagggttgaactgccagtcacccgccaacaagaccttctccttctctactcttgtaggcaaaggcgaaagacgtggaataacgaaatctgttgcacaaaccgattgcagacatatggccgaaaccagtaagtaaaaaagttttcttacattcatataggaactttgtgtttaaatgatattaatacaatttacatctgcaaattaacgatatttattcttttcggccctgataatagtataaacataaaacttttattcggaactaatttgcaataaatgcatcaaattcggaactacaggtataataaatgaaaaagagccattcttaacttactattaagttgaaaaatggctctttgttctcatctaattaccataaacatatacttcgctttcactcgtatagggttcacgattacttctcagcaggataattagcttttacgggccaatatggattctgatagatcggagaatcggaataggtatctctgtcttctgttgaagtgatcataaaatgttgcatggcaatcggattcagatagtgtgccatatgccagccatatccttcgtatgcccggtttgtcttcaaaatttcatacggacgtaaataatttccggttgatggagacgatacattggaattcggatcctgatcataaatcagattataaccagccatagcatatttctcaggaagatcggtattccatagtttaaatccttcaatatgatactttttcgtcattaattgatccatcgaacgccagcgtttcaaatcaggactacggaaaccttcactcaaaaattcattacgtctttctctgcggatattaaacaatgtagcatcattcaatatatttccggctgaataagcagcccagtcgagttctgcttctttctgcatattagtggcctgtattgttttagtataatcttcattgacatgggcacgacggcgtaatgtcttccaatattgatccgctttactatccagatttccataacattcgtaataagcttcaatataattcagataagcctctgctgcacggaaaatgtgtacaccagtttcaccctgccagttattacaatagagatgatcccaataccaatatttacgtgatacataaccggtattatttctcaactgtcccacaccatttataatgtccggtaaggcaggctcaacgggaacaccatgcgttccttgccctacgttcaaccagatattgatcatgcccggttgtttcaggaataggcgaatacgatcgtcccggttttcaactacgttttgggatgaattatcccctttatagagtgaagatgcataataaggcaagccgtcattcattaaataactttgaatcattcccctggtcaaaccgatagccgtacaagtcgtcccagcatctactgcccgattattgacaatgtttttacctttatcaaagtctctccaaagcaaaatttcgttatagccggacatatccattgcgctaaacatttcgacatagggattcgtgtcactcgctccctgcattaacacaccggaatttgttgttaactgatatttggaagctacaatatccgaagcttctacagcctgctccaaaaaccatttgacttcattgtcaatactgcctgacggaaactggtaacctttgttgtattctttgtttgcccccggccagccttctccgttcggaacaaaagccgtacccttaaaatatttcagccaagtaccttcaaataaggctactcttgatttcatcagataagcaatatctttatacaaacgatttttgcgtccatcgggagcagtcggcttcatcaatatggcagccgaatccagatcagaaataatgaagcgggcaacttcattacgcggcatacgcttggatgcctctgtcagatgttgcctatcgtctacaaacgtatggcgtacgatcggaaaatcacccaatgacaccagcttattataataagccactgctctaaggaaataagcttctccaatataatgttcaatattttcctttacaccggatatttttccattcttatacaagggtaataccttgtcaaaaaaatagttcaactgataaatctcctcaaagttccattcaccggcagtctcccccactttccagtcgccatccgtataactggaagaaaaattcataccagcctcattatccgttccattatccagaccgacacctccaccggaattaggtaaagctgtatatcggttaattatataagaatctaactgagattcttccgttaaataatcttcaggtattattgaagacggaggtgtaatttccagattatcattacaggccgttaaagtacagcccaggaaaaaagcaccgattatatattttattccttgatatttcatgattgtgaattttccattattaataagttatactcaatccaaatgaatagacagccgacaaaggatatttaatcatacctgccggatctgtagtcaatgtttccggatcgaacagatcagtcaaactggttccagtccataagttttcaccggttacatacacccgaaggttctgtagtttccatttatttaccaatgcttgtggaagcgtatatccaatactgagatttttcaagcggatataggctgcattcatcagataacgtgtctgcgcatgtttatttttactggaatcaaacagaggtctcgggtaatatccattcaggttcatacctaacggatggttttcatctgctctgaaatagtccatgtgttgttcgtagaaagtagaagaccagagggaactagctccccaaaagtctgaactaccagtaaaataatcccttttcataattccctggaagaatacacttacatcaaagcctttataatccattcccagattcaagccaaacatatatcggggagtttcgttacctataaccttcatatcccccagatcatcataagttgaattcccccagtcgatctttccgtcaccattcagatcgcggtacattatatcaccggcagcccagttatttcccatcgtattctgtccgccattaggcaaagtggccagatgagcatccatctcttcctgggtcttggctatgccaacagtctcaaatccccatatctcccccatgtctttaccggaataataacctgtaacagttcctgtatggttaggatattccagaatttcagtccgtgcatccgataaattgaaagctactctatagcctagtccattcttcaaacggtcacgccatgacacattcagttcccaaccatttgtacgtaaactcgtattattcgttttaggaactgctgtacccaaaatcacaggcatttcaggagccgggcctatcatgtcttcggtttttctcgtaaaccattcaaggcttaatcctaacctgttattcaaagcatttgcatcaaaaccaatattagtagttttgactgtttcccatcccatcgtcatactgataagacctggtgcagaagaagtattttgctgatttccattgatcagccatgcactgttagatgaaccgataggcattgtcagataagtcggataccaaacttttgtattttgatttcccaataatccgtaagaacctctccacttaaaggttgatatatattccgacaatgaactaaaaaactcttcatttgccatattccaccctaaagacacagaagggaaccagcgccaacgttgatccgaacggtaacgtgatgttccatcataacgtaaatttccttctatcagatagcgacctttataatcgtaattcaaacgtccaaagaaacctgcagtcgaccatttatcatatgctccgcctaccgtgggaggaaccgactttccgtctgaatcattccctgaggtagcatctattacatttgttccgggaacaataatacccaaacgcccggcacttgtcacatcctgccagagttgctccgactgcataccaaccatcactttgaagttatgcccgctcaactccttcacgtattcggtatatgcatttatattcaaatatttagttcctttataattctctgaaacacttgaattggcaccacccagcgtagattgataaggttcaccgtttacatcgtaattataaactttctggatatctgcatgtacccgttcattatataattgataattcacatcaccgataattttccatcctttgatcggttccacaacaatattcacctgttgagtcgtttcatatgttttctttgttgtccgcccgccatcacgcaaccgtaaagcatgagtcgcatattcatataaatttccattcggatcatatgcaatcaaagtaggccagctttgacgcgataaatttgaaaataagccatcagtcaaatgagtcggtttttcataatcgatctgattaaacctcatattataattaatacttatataatcatttaacttcgatgttactttcagatttgtagccacacgctggttattttctggattcaaacgcatataaccatcttgtccgagataatttactgatgcatacatctgaactttttcactaccaccagatacactcaggttatgttcgtgagagaacacagaatcatcaaaaatcatattgatccagtctgtatttccatagcctttatcatacaggtcagcccatcgggacggattgttcgggtcagggtcgattcctccagtcagcttgccatcaataaaatctctgatcttttgtaaacgttcaggagagaaatgccctgcttttccagcattcgtcgcagcttcattaaaataattggcaaaagtataagagtctactgtctgcggcatgtttgtggctttactccaacggaaagagttattataattaacagacatcttgccggctttaccttttttcgttgttatcagaataacaccaaaaggtgcccgagacccataaatagatgatgccgcagcatctttcaatacagatactgtttcaatatcctgaggattcaaacggttcatatccccttccatcccgtcgatcaataccagcggactccccgaagatccttcaccaattgtcccgacaccacgaatattaatagaaggagatgagtccaggtagccttgagtctgctgaatgtttaatcccggcattgctccctgtaaggcttgtgaagcattcgacacagaacgcccttcaaagacatcagaggaaacagtggagacggctcctgtcaaattcacctttttctgagtaccaaaaccaactaccacaacctcatctagtttctgagaatcttcccggagagtaatttgaaaagaagaattatttcctactggtacagactgcgccaagtaacctatataagatacttccagaattgcatcatccggaacatttaaagagaaacgaccgtctatatccgttatactaccattagtagtacctttttgcactacattggctccaataacaggaagacctgtttcatcgacaaccgtcccggttatctttttttcttttttctggcttagaccatagttcaactcgatctctgaccgagttgaactgatcatgatcagttctggcataaacatgactagagaaaggacttgtgcttaacaaagttgtaagaaacaaatatccccctcgtttccacacacacatttttttgttttccataataacaatgtttaataaaaccacgttacataatactttatttgtaaaagattcacgattacaaaggaagttactatctcattatcagttagtattatatttgaaacaaaaccttttaaattcggaacggattcttcaaaaatgtatcaaattaggaactcgataaaaaacttcttgttataggaacaataatattgtatttatgatagccactatacaataaaccccgaaagcgtcaatcaaactttcggggctcatatagagaaactgtttcaccaattctcaaaatcaaccattaaaccatcaatatcccggattctgttcaaggtttccgtttatatcaatttcactttgaggtatcggaaacagataatgtttcggattctcaaaagtacgcgtcgtccctcccgaacagcattgacagcttcataaacaacaatattataaaaatttgttttttcatattgcctaacattattgtaaatctcaaaataactttttctcttccccttttcttaaaaatactgttgtatcttttccaccataaataagtataacatcaccatccaacgctttcgatcttattttagcattcagtaattttccatctttccaatccatatccacttcgtaaccaccacgggcacacaagcctctcacagaacctgaattccactcttctggtaaagccggtaataaaacgattttcccttcgtggctttgaatcagcatttcagcaataccggcagtgataccgaaattggcatctatctggaaaggcggcgcaattgtaaacatattatccaatacacagttttgtatcaatctttttacggaagaataggctagctgtgaatcagaaaaacgagcccccaaagaagtcatccaagccatactccatcccacagtaccatgcatatattcaattctgcgatccaatgttttgcgggctgctgcaaataactcaggggtatttctattgatttgattggcgggaaacaatgcatataaatgagatatatgtctatgccccggctctgcttcttcatattctttatcccattccatcaaacgtccatccgaacctatttccgttttcttcaggttcggcaacatatcccgaaccttccctaacaactcattatcaacagataaaacctctgatgcagtaacataatgctggaacagatcgtctatcacctgatggtcgtgtgcagatccggcacagatatgagccccttctccggttggtgaaataaaggtattctccggagaggtggaaggaatggaaatccattttgcggtggccggctcccaataaagccagtctgtgtaaaattgagttgtatttttaaggatcggataaatgcgcttcagatactccttatcccgggtaaaagcatagtgctcccaaagattctgacaaagccaaccggctgatgcgacatgagaaccccaaccgaaaccttctcccggagaagtgaatccccagggattaacgattgtatgggtactccacccttccgatccataatgtacctgcgctgtcttcttgcccgatacctgaatatcttccagcagatcaacaaaaggcatgaacatttcaggcaggttcgtgctctgtgacaaccaataattcatctgaaggtttatgttcatatgatagtcaccattccaagctgtttgtattttttcaccccaaacaccttgtaagtttgcaggcaaagaaccttcgcgggaggaagaaatcaatagatatcggccatactggaataacaattcctgcagatgcaaatcctccttgccgcttcttgcttccgccagccggagatcggtaggtatagtatctttcagatgttcagtaatgctaaaggatacacggtcataataggttgtataatccttcaggtgattatccagcaatttgtcataagattgcgccatagcattcttcaacagctcggatgtattttcctcataagcaatgtccagataagaaggatagcccgtatagtttgttgcagatgtcagatatagaattacttcgtcggcattatgaatggtcagttgattgttttcaatctgcttatcccctcctttcagggaagcgtccaagcgtgcccaatatttcattccgtcgcctccatatccgtcattcatggctcctctcataaccagttgtccttggtcttcaacaacctcataccgttccggacggtccatcctgacagagaagttcagttttcctttctgggcagatttaattttcacaacgataacattatccggataacttgcgaaataagaacgttctatcttatttccgtttacattgtatgaaacattcaccatagcccgttccagatccagctcccgataatactctgtatattcagacttatcggcaaaatcaatatagagatctcctaatgtctggaaacaaccgaacggactgtcggctgctgatccggaagtagagccttttccccggcaaatctgcgtacggctggccaatgcttctgcctccttatatttcccggctaaaagtaatttacgtatttccggccgggctttcaaggcttccggattatctccgtcctgtggactccccgaccagagttttttattatttaactgtacccgttcggtaaaaacatcaccaaataccatcgctcccatataaccattaccaatcggtaatgcttttacccagctcttattgttgccccattcccggggattatcttttacagaagcgtctgccggtgctttataccatagcttcatcgtattatcttccatatcattcgaacttatacagcccgaagagaaagagatgactaaggttaccatcggaataataatattccactttttccacgtattatgcatgattacttgtttattagagactatattactttataaaagattctttcacaaaagtaaaaagactctattattgtcatgttgacaaaataaggcgtttattttgcacaatccgtccgtctggctttttagtaaggtgagtaaaaatttagcaagttttaaactaacttttgatccaaaagtagccaaaagatcaaggctgcacctggttcgctacttcgcatcctacgttcgctgtccccggcgaagcgagtttcggatttttaaagcgtagtctttccccgtagcagcgaagccggtgcagccttgaacttttggttacttttctttcaagagaaaagtaacattcaatacagttttttaatattataatgtaaactctccgttcagccggatatcatccgaagccgctccaaccattactttgaagtcgccgggttctactacctgtttcatttcctgattataaagagacagttcctcttcacctaatgtaaatgttacttttctgctttcacccttctttaaggcgatgcgtttgaatgccttcagcaagatcggagcctgggaaacagaagcgactttgtcgcagatataaagctgaacaacttcttccccatcacggtcgccagtattggttaccgtgcaacttactgtttgcaaggcatcttttccattgcctttttgcatttccagctggctgtaatcgaatttagtataactcaaaccataaccaaaggcataaagaggtgttccctcttcttccacataagcacgttgtttaccctgcgaatagaacaaaggtaactggccttcgctacggggaacggataccggcatacgtccggcggggttgtaatcaccaaataatacatcagcaatagccgtaccaccctgttcaccgggataccaagccgtaagcaatgcctgcgctttttccgaagccagattcatgttcagggtacgtccctgaatatagacaactaccaggggcttacctgtcgcagctactgcctccagcaacttctcctgatcgcccagcaaacgtaaagtactgcggtcgtatccttcgccacaatccatgtccgacaggatctggtttccgtcgttagaaacatcagcggcaccggttcctatatattttgtcttaaaatcacgggcactggaacctcccacaaccaaaacgaccacatctgccgaacgggctgcatccactgctgccgggatattacttgctgttacgtcacggatggcacaaccttttacataattaactttcgtggaaggagaaacagctttccgtatgccgtccaaaacagtaacaatctcttcacgttcctgaggagccgtgtagtcgcccaactggttatacatcatatccgcattcggaccgataacggcgatgcttccgatattttttttcaaaggtaatatcccatcgttctttaataggacaatcccttcacgggctacctcacgagccagttccttatgtgctttcgaacgtaccaactgcttcgcctgttccggagaaacatacggattctcgaacaatcccatacggaactttaaacgaagcacattagctaccgccctgtcgagatcattcattgtgatggccccctcttcaaaggctttctttaagttcttgccatacgcatttcctcccaggtccatatcaagaccggctttcagagccaagactgcggcttccttattatcttttgccacccttgctccgacaattccttcgatacttgtcagatccgaatagacaaatcctttaaatccccactggtcacgtaatacatcggtcaataaatacttattagaagtgcaaggcacgccgtcgatagagttgtaggaagtcatgatcgttcccactccttcttccaccgctttcttgaaaggaggcagataatcggagaaaagctggcgcataccgacattggcacgtgcaccgttatgtccggcttcaggaatgccgtaagcggcaaaatgtttcaaagtagaatatagatgttttccgtcattctgcgattcgccctgcatacctttcataaaggaaacgcccagaatagtcgttaatacaggatcttcaccaaatgtttcttccatacgcgaccaacgcggttcgcgggcaatatccagtaccggaccataaccgatgttagctccttgcgaacgtgcttccaaagcaatcgcctcccccatccggtacattaactctgcattccaggtactagcctgtgacagggaagtcggaaagacagtagtaccgatcgccatgtgtccgtgtggacactcttcagcaaataagacagggattcccaagcgggtttcttctaccgcatatttctgtaatgcgttcaatgctttggccgatagttcggggttcaagccagtctccaatgtcttttgcgtccaggggtcagcacggagaactgcccagaatgaaccgataggcattgctttcatccgttctttataaagatcggaggcaactacgccattttttgttttggtatacatttcccaccccagcggacagcatagctgaccgactttttcttcgacggtcatacgtcctaccaggtcttttaccctatcctcgacaggtgccgtagcctgtttatataacggctgctgagctatagcctgtcccgcacatgcgataaggccgattatgaaagatgttgttttactcatataactatattgttttatttaagagattattagttttgaatgtctcaacaattatcaaaatgaatgtttcactatttgacagatttgagctattttatggtgtctgttcaagtgacagatggtaactgattcccctcttgagaggggataaggggtgtgttaaagcctgtttatgccgaaactataacacaccccctgccccctctcaagaggggaaaagttactcccgtcactgtaaatggatagctcatatcttgctagaagtgaaccattatttcttaactgtaaactgtaaagctatcggttcattctttaatcctttcggaagagtaacctttactttaccgtctttgctgatgtatttcacggtcttgtttcctttcagcattttcatcttgcctgtcgggatatttccgctccattcgatcgtttcaggcaggttctctccttccggcaaagcataaacggcatataaggtcttaccgtctttatccgcagtaaaccaaacattaccatcattataaaccggagtgatacgggtattatagatcgctttcccgttcgttctcaaccattctccgataacatgcagacgttcagccaccgcatcttcgatagttccctgcggagtcggacctacacctaataacaaacatccccccttcgccgtaatctcagccaaaagatcaatcactttagtcggtgacttataaggagcatcaggaacccagccccagtcattactcaacgtgatgcaactttcccacggattattcaactgcgtttcggggatactgcgttccggagtctgatagttttcatttcttccgcggatcgtacggtcgacagagatcaaccccggttgtgtggaggtacgcacctttgtcaacagtttatccagattgacatcatcaccggtgacccagccgccatccagccaaaggatatcgaagttgccataatcagtcatcagttcattcatctggttataagtgaaatcctgatagtttttccaccagtctggatgattttcttttttataattctgacgacggttggctgttgcaaaataaggattccagaaccattcgcaatgccagtccggtttagagaaataacatccgatcataaaatctttctggcggaaagcatcaaacacgtgacgtgccacatcttttttcggatcagtaccgaaaggaccgttcgcgatggagaagtccgtgaacttcgaatcgaacatacagaaaccatcgtgatgcttcgttgtaaagatcatatatttcattcctgcatcctgcatgatatccgcccatttagccggatcgaactgtgtcggattcaaagagtccttcaaaccgtaataccacttcttgtattcatcgtaggtcatatctttcttgcgggaaatccagtctacgtcctcggagcagatggaccacgactctacaatgccgggaacagaatatagtccccaatggaacaaaacaccgaatttctgatcttgccatttatccagtttatccaaaaccttttgatctttaggccactcataatcagttgaacgttcgtgaacaaaaccttgtacctgttgggcgtttacattcatagtcaaaacggttcctgccaggcagccgaatagtgttttcaggattttcataaaatcatcgttttaattattgtacaatattaatttttcgtttaagtcaagccttagatggcattagaaaatctgtacaatattacagataatatcccaaatgtcaaaatgtagcaatgacaatatgtaataaaaaaatgcatggacctccccgacccatgcatctgtcaatcaataactctaattattttaaagaaccgtttagtgcgattgcttttcctttatatcgatccattgtcctttccgtgtttcaatcgtataaactccatcttcattcgttacatcaccctcattccctgttacggacacttcgctgccatccgcagggaaagcaatgcgcaacttaccgccttgttccggatagatgcgaagttttacgatcttgccctcttttttttcggcagacaccaggaaagcccccatagcacgcaggttatcgaatgagacatccgaccaagcagcaggaatagccgggaacacacggacgattccggtatggctttgaagcaacatttcctgaataccggaagcaaaagcgaaattaccttccaatgtgaacggacgataggtgaattttgattttccactctttgtctggtcaccattcacatggaacgtgttacgaaggcagaagcattcggcaaacgtacgcagttcgtcggcagcaccttcgccatcaaaggcacgggctttcatattgccgaaccaactataggaataaccggtccagtaatcgggagtatactctttcagtttcttcaaagttgcctggatgatatgctgcgatttctcaccctgactccagtctaccaatcccagcggatgaattgccatggcatgggagaaatggcggtgagactgctcataggggaatcctttggcaaaggtcagggcaccttctctatcaaggtcgagatccggcaactgatcattcagctctttccagtgagacgactcgtcggacaagttcagttcggcagccagttcagaggctgcaccaaaagcaaacttcatcagggccagatcgtaattggtcatatccttgaaccaggcattgatcgagttatcgaatatttcaggactggaactcattaccagtttacgaacaccgttggcatcgactacggatatttgttccaggaagacagccacatccttcaggaacggataagccctgtctttcaggaattcacggtctgccgaatatttccagtggagatagaaatgctgtgccagccaggcaccgacggtctgcgacatagaatactgtatccaccctcccatcggtacgccctgcaaagtacataccccggggatattcataccgtctttttcaaaatattccttcgtgtactttttataaacatcccgctggttccacaacgtattcagataacccagaccttcagtcagatggttacctgtataagccggccaataactgagttgcgtgttcaggtcatgatgataatcgcctttccagggtggaagtttcccgttatcggctgtccagacagcctgtaaagaaatcggataagagttctcacggctggcagaaccgaacttatacatctcattatcatattgtttctgcaaaacaggatcaggaagtgtaatggatgactgcacccaataatttttccagaagtccatatgaacctgataatcggagtcgataccacgggccattgcttcctgggtcttttcgactgctttatctgtccccaaagaagatgtcacgctccaaacaccacaaagcgtatttcctttttgctgccagcgaacatttacatcatacgagaagccgttccaaccttcctgatgatagctgatctggttagtctcttcatttattgttccttgctgatagcccagacggcgcaaatcctgtccggctacagagtcacctgttttagtatctcccgtactatatttcggggctatcaatgatggggctatagccgccggcagattttcgaatacaaaccaaccgactggttcggttgcatgaacaaatgttttcatcgttgcaccattttcccaagtcgcttcgcaaagagcattattcagataaagacgaacatcggaaggcgaacccagttgctccaatgagaattccagcgcagcccccggtattttagacggggcaggctgttgctcatacggatgatcatatttctgctgaaccgggagatagtcttttttcttcacttgctcacatacccatgcgaaacggttgttcggtccggagatactatccatcggacgaagatcccacagatcggtgcggtccagcgacagacgcaaagccgaatcacgctgccagattaaggcgccgacagttgcattacccagaggcatcccttcatcccaggtcgttgccaggtttgggaattgcaaatcactttcggaaggagtaaccggcaaattactcttcccaccggtacaggccaccaacagccagagactcgatactactaataagtttttcatcataaatataaagttaatattattctatttcatcagtttccctttgataccgaaatcatcgatcaccaatagaccattcccctgcttcatgacggcaatataaaaaccgtcactttgcggaacagtaaaacatacccggcatttccccggacgattcagatcataagagaagacgggcactgcttgcgagggagagattccgacaacctgatagacatctctacggtctactttataatcgaactcaacttcgtaggtttctccgggtacaaaacggatcatcgccggagaagtcctgtacacttcaccattccgttcacgccaggtggccagcgaccagttgccattgatcgtgttgtcggtatagacaccatgcttctccgccaggtgcgtagtaaaagcacttggttgacaagggataaacggtccccatccttcatccacatgctcaaaatcttcaaagtaatcgtaaccgtttttctgaggcgactgataggcaatcacacgcacatcatcaaaagccacggccgaggtatcgcaagaagcatcggcacgtaaagacaacgtcacacgattactgccggacggcacacggaaaggcaacttcaaccgttgccaggtcgttttaaaacgatccgtattgtcggtataattaaacaccttactttcttcaatcgaggtttgttcattcagcaggttgccggcctctacatgcaagatggctttcttccggccggtaacgtttacccatacagaggctacatattcctgtccgggagtcaggccatcgacctgctggctcacgttggctgccggtgctcctttcatcgacaaataacgctgaccgtactctgttctttccatcgaaacggcagtagcatctcctcctaccttccaatgatcgaacgaaccgctatcaaatccggtgtctttcagcggacttccggcactccattccatttcctggggctcttttttctcttccttatataatacatagcctgtctccggcaatgcttctatctctacgcctccgttacgtacggaaagtttggcgacaagcgtccttccgttgtctcccaaacgatacagccatgcattgctaacagatttccaggaagcaggaagttgccaggatgtcttgcctccctgcgtgttataatgataaatcttttcttccgttgcaggattccagggaatgaacacacttccgcctgacatcaatacctggccgtctctacgaatcaccgtcccctcttcctcacttttataagagatcaaaccgtctgccaagacagcacgaacggtatcgagttgcattaacgggtaatgcatcaaatagcggtaaggcaattgtttggtaaagaaattacgtaccactccatcaaagtcgcgccctttctgccatcccataaatccgatttctgctccacggctgtaaccgcctaacagagcaggatgttcggcatatccgtcgcgataccgatgatgtacgaagcgatgaatcaaacttttggcttctgggttgtaatggatccaaaccgcttccttatcaaatacatcggcatcttccgtccatattgcccaaccgttttgattgaacaatctggccgtctgataagccagccaacgatattcccgataggtatcgagataaacaaacgagaggtcgggtacatctgctttgagttgctccagacgcttcgcaaaagttcccgcaagcatatcggcctccttattgataaagaaagactggtccagccaactccaggccggcatgtcggttacgatccggtcgttgaatgctttggcttcgggatatgattcgctatgattgatatgaacaccgatatgcgcattgtatttccgggcttcttttgccagaaaagccagctcgtcctttccgccggcgcgttcgttatagctacccgagtaatcaggatgcccactgtcgtgtccttcactctgatagcctttcagttcgagcatctgtccgaaaccgtcggttgccaggtaaaatttctttatattatccaactggcgaaggaacggatactgagcacaactggcaaagttcatcgtgatcgtagcatacgagttctgcacccgatccacaccgaaaggaaccggatatactttttgcaaagccatcgccccgtcctgccagtcgactttgttatcccgattacaatcgtctgacaggattacttttatataaggaagctccacaacctctcccgcatgcccccggtaaatccattcgtttccccagataccggttacaacagaacctgccgtttgcaccgactgatataaaaactggcgggtattatagatcgaattactttcaagagttgccaccaacttatctgaattcaacaaaaggatggaaccgtattgatgggtatggtctatcgctttatccttcaacggatagaatatatcggaacttacattattggcaatagacaaacaggcctcgggagtcgatgccgcaacagataccagatgatgatccgggaaagcgaatgtcttcactttaacatcgccatcttcttctattccggttacggacagttgaagtacgttgtcggtcacttcacaacagacattcagtgtaacccctatttcttttaccttcaaggtataatacacccggccggcctccgccctactcgtcactttaggcaaataataatcgccatttatcgtgatgcctttcacatcaaacggctgaccgccgagctgggattggttctccttccagagataagactgaaccgatggaaaatctttagttaaccgaacgtccatccgggaagaggacaaggtatagccacttttcttttgggctgcttccctcttcggctccgtcagactacggcaaaccacattagatatttgtacgttccctttgtcgtgcacacggaaaccggtctgtcccggtaaaagaggaagatccggtatgtatttatgagcgatctgttctccatctacatatacggtcagcgtacgtccgatacagttcaccttgatacgacggcggtgatgtgcatacaactttgatatgtcgcgggctatttcggtcttcccgtttggtgtttcgacataccagaaagcaaatccaaaatggtctgttgccttatcgcatcctacatacacccaatcgttttcgtttacataacgtaataatacgccaacctgcgccgacgagttctgtggcaacaggtcgaattcaaccgtactattaacagcagagaaatcatcaatcagagccaaactgtcgaggttactttttaaataataaatagaggaagagtttttcaccccttttcccggttgcagaacagcgaaagagcttgctgagatcagacagaaagcccctatcgttaaaattttattcatttacttaagtatttacagtgcttatttatggtatatcgacttgaatatacaaatataaagagtggaaatatatttttctcatatatttccactctcttttctaaaatctcgtattttgcaaaatatatcaccaattttgcaaacaccggcctaaataactttcctgattattcctccacaatagcgactttcgagataaccagatccggtccgttcttcacctttgctttaaagcggagaataccgtcgttcgaatcctcacgcataatatgaagtttcacccatgactcttcctgatcctgtttgtcagattcatactcacgaccttcgaatacaagatgccctgtacgtcctttcttatccttgtcggcaaaacaaacatataaggaaccgattattcccggagggcactggatagtcagttccatctctttcccctgccagtccggagagacctgataagtagtcttctttttggcaaatgtcttatccttatcggcacaatcgatatacagcaacgcattgccgaactccccggtaacggtgctcttcaacggttccacataggtcagcatcttctgtagagaggttatctctctctcgtaagccggattgaaatcagttgaattcatgtaatgcaggatactgcttttcagctggcgggctaccggattcgattcgtctttcaggtcaaaaccgcaaaccagcagttttcctttaccgactttcagttcgaaaatagatgccagcttgttgttacgatggaaatcgtcgacaggctgtgcgatcggcttatattcctccggatagtcgtttatgtagaaagcacgggcatctttatagatagactgccattgccagtcgctatgcgattcggtcggaaaccgggcaaagagcggatgtttgtcgcgaacaatcataccgatcgtattctttccctggccggggaaaaaggtcagcgaccagtataaaggatagaaactaatcttatcgcaggtctcttcggtacccaaagcggcagcctgtaataaaactttttctcctttttccagacgtttcagacagtcggcatccatccggtcggtgacgtagaccgtaccggtttctactttttcatttgccggaaatacccagatattccaggtattggcaatagcatcgttttgcaaacctacctcgacaaccaacttctgtgctgttgtcacggcagacaggtcacaggatattttaccggctatatccgaactaccggcaggaaacgtgcggtttgccgtacgcccggaagcgaccagattgccttccgcatctttaatcttccagtataagccatcactcagacacgtcgatccgtaatgagccaactgaagatcggcagtaaacggttcgttatttgtccacacatatttcgggatacgtagcaacggaaccgtactgtcatgatgacaacggaactgttcgggtgtagttatgcccttactatcgtaaaagacatccagccagccgaccagcgcttctccctgtccctgataatcctgcatgctgagcagttggatgccggcacaggaaggtgtacgcaaaaacgattctatctcatacttatacatgatttggttgagtgcaccggatgcagcgacaaactcttcattctgttcctcgatcttgttcttacgtgcctgctcgcggaactcttcgaagttacgcgctttcagtacccctttatatttctttatttcactccaccgagggtagacaggccattgtccgatctcatgggaaagcacagggatattcgatttcgaataaacgtcttcaaagtcccaagaggtagaagcaccgcctttcaatccgcgggcacttcccagtccgttgatataatgagtagccatatactgatcgaccggcataatcttgcgggcggtagacacagaatacagacggcgtgaatccttttccttcaatggtttcatccatgattccattacttcaaaatcagaattacccaattcatttccgatacactgcatcacgaaagacgggtgattaccgtaggcatcgatcatacgcgttaattcctgttgcacataccggtcggcagaaggattcttacccagtccctgcggataccctttcgtattcatttccggtctgtctttttgctcggaagacatccaccagtcgatccaaatggtttcggcctggatataaataccgagacggtcagctgcaatgaaagcggcttcgggcgggcaccaggaatggaaacgtacatgattcaacccataatccttatagatacggaaaatcttttcccaatcttccaccttgcaagacggataacctgtcagcgggaaatgtacacagtcgaggttgccacgtagaaagacaggcttcccgttcaccagtatctttgaattggaatgggatacctcgcggaaaccgaattctatttcacggctgtcaaactgtttcttcttatcttccagcgtcaccttcaagacatacagattaggagtgatatcattccaaaaacggatgttctccggcatagtagcctcgaaatcaaggatattccggcctttttgtaaaagctgttcaatggttcgggtatagaccacagaaccatcttccctgtcggtcagttgccaggtaatacgggccggaaccttccgggaggattcattgataagcgtatccctcacctgcaacgtacaagggccgttggtcgtacgggtaaacacctgcggattcgagaagcgtatcggctcggatgccaccaggcggatacggccgaccgccccattccatatgctttgtgtatactcggaatagacatgacctttatcgccaatattataaatcatatcgttatcaatacggatagtcagccgatgtttgccgggtgtcagatagcccaagtcatgccagtggggagtagacagggcatcctgcacagatacttccttcccatccagaaagagacgcgattcccataagacgcgttccagttccatacggatgtattttccgttccattcggaaggaatttcaatttctttcgaataccatgccgggccgtaatatttccaggcacgcgtcaggataccgaaatcggacccggaagtcttctctccatagccggcttcatcggtcgtgccaggcaaggtgatatgatcggtaaaagaggttccctgccagttttctttcaatcctttgtcttccggatcgagcctgaactgccaggttccgcttagagactctacatcctgcgcttgtgtaggaatgtccagacttaaaaaaagtaatgcgatagatacaaaatttgtaagcttcatatattatttatatttcagatatcatcagtcaggtttatcactatcccagcattctctattcagtcataaaccggaagttatattcactaaacgaccagatttgtttgcctttcggaacaattgcttttcctttcttacggcctttcttgtcgactgttacgcttaggtcgatacgggtaaacgctcctttttcataatcatagctactgccatcatcatcgtaaagggaataagtacccggtttcgttccgtaatgccgtacttcaagcggatatttctggtcggtaaattttgccatagccggccacaacgggatgataccgccatcttttacatacaccggtatgtttgagtcagtaggtttcatcgtgatcacttcgccctctcctgccagttttccggtatagaaatcataccatttacctttcggaagaattactttccgttccttctgtccggcaaacaacggagcaaccaaaatattttcacctaccataaactgatcttttacttcacgacgtatagccattgcataaggattctccgttgcatccagctttccctgttccgttactgcttccacagcataaccgtcttcgaggttcatggcacgtacgggaggtgtcccgtagaaagcgtaatcggcaaaagtcgaatataaataagggatcaaccggatacgaaacagggatatttctttaatctctttctctacatccgggaatgtccagggtttagttccgtctgcccacgcattcaattgtgcgataggagaaaaacaaacggtctgcatacggcgcagccattcttcggacgtttttgacgaacggacctcaggcgtccacaatacgccgataaaggagctgtttatcaatgcagtgataaaacctttatgatcgtaatagtcgttatacaatacataagggtacgagttggttccggcattggcagcacgaacctgtccatacgtacgtttgttctgttcgcggtacatctttgttgtcgcatattgcatcagggaaccataaaggtttcgcaactgttcggccgggattccggaagggaaagttgccacgtcgggccagagccagaagtcgtagccatcgttttcgtccattttataaccgctgacacccatatcgagctgatgtttcttgaaatgaccggtcatgatacgttgtacctccggcatggagtaatcgggtacctcacccagccatacggtatgcgatccggtataaggtttgatcttgtcgtacacttcactgtgtttagatacatacgggttcatccacaggttcagttcgattcctttatccagcatctcttttacaaatccgggagcatccgggaaacggcttttgtcccattcgtaggtacagggataagcctttgaatgccatcccggttcaaggccgatcacagaaaggggaaatcctcttttttcaaactcagcgacctcgttcttcacatccttatcggagaaaagcgtaggggtacgatgccagaagcccagcccccaacgcggaggtaacgtaccgcctccattatacaaattataccggcgcacggcatccaacatggtcggaccggcaaaaagcaacatttcgacaccggtagcgggaaccagtatctctatattatccgaatagggttgcgaaggccagtccgcatccatattacggtctttttcttcgggtgcgttcgggctgtctttacgaacggctgtccccacccatacatcgatataacgggctgaattaatcaatacaccgtatccgcgggaagagacaaagaaagggacgggggcatgggtacggccgtcatccttgtcgccataatggtccatgtgcaggcgcatgatacgaccgcgttgctcaacagttttaaaatggagtcccaggccgaatatcttctcccctttttccagcgggaaactgatataggtttttccatctctcagttcgaccttcacatctgagggagaaataggtaaaacgccttccggcatttgttggagagcctccctcttcggggtattattaagctcactcaataggttgattttttcaggtttgccaacagatagtttccaaactccggcacattcattagtaccccaatcttttgaagtaacattcgattgactaaaagctactgccgcgtaaccgatagccgctaacaataaggaaagttttctcatggtattgttttatacgtatttagcatgcaaaataaaagtttttattctgaataacaaatagacgaacaatggtcaaagatggataatctttcgaagaagtcctcctaccgaatatgcataagcaatacgtaatggttgcagtaaacgctttaccagatgtttcatcgctatctcggcctctaccggaggaatattacgcaaaccattttccacagccacccgactatatgtcatttcttcccaggtaaaatccctgctaattcttcttttcatcttgaatcgattttattttatacgaataatctactccgaacaaagctccggcaaacgtgcaagtttccccgaatgccaccaatacactactatggatctcccctttcggagctatccagaaaccggagaaaagaaggacaatcccgctcaatacgagcaggattgccattaccaattgaattgtcagtctctttttcatacgttccccttatccaactaattaattttcaactttcaattctctattttcaatcactcgataacaggacgatcgtcctcttccccttttttctctaagaccttcacatcgtcttcttcaaacttcgcaagttcgctcgtccagcgcaggctggcacccggcgtaaacacaatacgagcttttttaatcatagaagcattaaatgcctcttccgtatccgcaccttttgaacggagcgaaaaacggaaattaccgaattcgcccacctgcacgatacttcctgaacgaagttccaagcccatcgcccaatttagtgagtcgagaattgccttcacatcagcactcgacatcgccgaacggctggatatcaattcacacaatttttccatatcgcaatagctcgatgatttggctaccgcataggttttcactttgtccttgtcgtcgccactcaggaccttacgttgtacctttctgaattttaatgccatacctttaattttaaatgattatgcagttgtctccggggaacgatacaaaggtatgggtaaccagatatgttaaaaaagcaacaatcccaaccaataaagcgctatacttcaatgtattacaatcttaaaatactttaaacaccacttttagcggctttttactacggtctgttttaacttttataaaccatttagtatcagccgttgtagtcatccttaatttttgttttgcctgataatatcaatacatcttcaggagtagtcttttctttactgattttttcactcaaggttttaattttttcggaaaagtcgaagcagattaccacagacatagccaggcgactcaatgatgtttttgcggtacgctctaccgcttctattaaatgaagcattcgaataaacaaggtaggatagcgaagtgtataccggatatgacccatcacggttttttgttgcataaagtcggcatatgcctgtcggtcatggataatcacttcttctataaaattccgctgataatcaggcaacaccgaccaggttataaaagaaatcttatagattttctcacgtaatcgttttctcccgtcttccgacatggcatctaaactacgattaaattcatccacatcaggaagttttccattgggaaacaatgcctcaaacttgtttctttttttcataagcagaataagattagtttcattttaaataaaaaagagggtcactacaaaatctcattttgtagcccctctttaatcgaatagtaacataaatagcccttatatccggactgtaattatctttgtatatcaaggatttaaattctccaacaataactttccgggtctaaacttcacactcgtacgcggttttatcatacaagtttcaccggtacgaggattacgcccttgtcgttcggtctgtttccatggttcaaaggttccaaagccctgaagtattattgcatcatcctgtttcaatgcatctgaaataatttcttcaaaggcatttacatatttccgtgaaatatattgaggaatccccaactttccggtcaatttgtttactaaatcgttcttattcatatatattcgttttataattatgtttcgaataaattatttattcatttcacctactaataagtacctcgcacacatactacattattagagttatcattccaactattatttccccctgagatgcccgccccagtatccatatttacataaggggcataagaaggggttccaccacccccgccatctccccagaatttaccagatagagaaacatttcctatttcactttttccataataaattgcagttaactctgctctggatggtaatctccaatcactatatcctaaatccgataaattattgcaataagtcggtgctgcagtaccttgattataataccatccacgtcctctctgagctttactgaccattaaagaagtggttcccggtacataattatttccattcttcggttgcgaaaccgtgatatcgaacgtacgagccggttcagcacctgttacggaaagtgtaaaaactgctgaccgggcaactgtggcactttgcttagctgttacaacaaactttccattcgctacatcgattccggaaaaagaaaaatctgtaaaaccggactttttagtaacagtccactgtagcccttcagttgcagttatcccagaaacagtaacgttccctcccacagccggtattgttccaccattagctggcacagttatattagacggctgttgtgttatggcagcaatctgcttttcaagagcagcgtccgttccacttatagcattcccggcttttataaatagatatcccgttcgggtcgaggcattgggatttacagttaccgtataagaaactgtcggcgtagtagtagcacttgaaactacaccggtagtagtacctgtcaaagtcaaccagtcgatagcttcagacaatgcccatgaaagaccttctgtggcagaaaaagaatattcggtgtccgaatgaggaataccctcaggacctattgtcttatttttagaagtagccaacaaaaccgaacctttttgctttaccgtaacgcttttttctgctattgtaaaactttgactacgttctgttgaactcggatttgcagtcactgccgtaaacttcaccggagcagggccgttaaaattcaatgcaccacccgcagcaccatttgtttccccatctactaatgccgataaccagtccggtaatgtaatcgtccacgcagctcccggacgggcggtagcctgaatggttgttgtcgagttaaccgcggcatctatatcagccggagccacaatatcaggaaccgtgaccgacacgcgaggatcggacaaatcgattccgctcaaggtcagattcacgacataaggagtatttcttttcagattataatcattgaaattattacccggatatatacgaaaagaaacatccgcataagtagttccatttacagtggcatccccgacaagctcgatataagtagcatgcggcacagaagcagaacttcctcttttctcacgtgcagaagtagcataaccgtcttttccattggtaataacacctgctatattttcaggtatataccagttaaatgaagcagaagtaccggtcggaattgttttagtaaatacctgataggccgttcctgttacttgtctggctggttccatacactgtatttgtgtaggaacgtcatataaggataaacgtttaggagtaaaactaaaaccggatttgatagtataattcaattgaacttttgtaaccatacgcgttagtactactgactgtttataatttattgatatagattgattatctagctgtgcgaatatcgcacagctaaggtttaccggtaaaccttctgaggtggtaagaccttcggttcccgttgtataatcgatctttgtttcattaaatgctgttaatgttgcaaccttacccaaattaccggcattgccgacaaagcgaaggaaacaatcaggagactctttcagctggacctggatttcatttcctgttacatctgtcagataatgaaatatcaacaaattcccagaagcatcatactgacccaaccaaagagtttttacagaactttcatcgacacccgtcgctctggttaccatatttgatatttcagtagttatttcagaagggtcagatcccaactcttcttttgatgtgaatgccacactacgtgttataggggtaacttcgccctctaatgtgaaataaaaacaaacatccacatccttcattcccgaactcaaaaacggatccttttccatattatcggaacaaccggataataaacaaagggtacaagctaataatatatatatcatttccattattatgacatttttaaagtgatccattttacgatatcaattccctcgtacacaaaaataagagtgtggggtacaaaaataattattgtttaacgagccattggaaaaagaaacgtagggagcataatgcggaccgcaactattatcagcagcccaagtagactttccccaataaagtcgagttgaaaaattacagttcatatcattcttaactttaaacatattttgtaattcagccccagaaggcaatcgccaatcactatatccaccataagaaagattattacaagcatcaaatgcggctttgtacaaataagttcctgtaccccaaccgcctttacaaacctctaacgatgtatatcccgggacatgccatccatcataagcagcctgattaactgttatcgtataagtacgagccggacttgcacctgttacagttagtgtaaatacggcgctacgagcactttttgcaccttgttttgcagcaatcacaacagtgccatttccactaccggaagcaccggaagagatagaaaagtcagcccatccgcttgtacgggcaacagtccaacctaatccggtcgttgctgtcacattaaaattaaccgttcctcctgctgccgcaattgttccaactgtccccggtgcactaattgcagaagctgcctgatctatttttattgttttagttaacccggcatcagtccctcctactgcattgcctaccttaaccgttatatattccgaacgaaccgctgcatttggatttgtagaggtcgtttcataatttatcccttgagatattcctgtcgtattattcgttccgtttaccgtacctgttaatttcacccaattagcacttgtcacagcccacgacaaacctttagtagcgataaaagaagttgttcctttagatgttatttcagcttttacgctactactggccggcaccgtcagaactgcccctttctgtgtaatagccgatatttgtttttcaagcgcagcatctgttgcgcttattgcattacctcctcttgcactaacctttgctaagcgggttgaagaagagggattgactgttacactataatttaaaaccggattaacagtcgtagtagaaacaactccggtagtcgtcccgcttaaagtcatccaggtaacgtccttccctaacgcccacgaaaggccatttgttgccgaaaatgaataatccgtatctgtatacgatgctgcttcaggttctatcgtcttatttttagaggtagccgacaaaaccgaacctttttgctttaccgtaacgctttttcctgctattgtaaaactttgactacgttctgttgaactcggatttgcagtcactgccgtaaacttcaccggagcagggccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctattgtaaaactttgactacgttctgttgaactcggatttgcagtcactgccgtaaacttcaccggagcagggccggtaaaattcaatgctccacccgcagcaccatttgttttcccatctactaatgccgataaccaggccggcaaagcgatcgtccatgcagctcccggacgggccgttacctgcatggttgttgtcgagttaactgcggcatctatatcagccggagccacaatatcaggaaccgtgaccgacacgcgaggatcggacaaatcgattccgcccaaggccagattcacgacataaggagtattccgtttcagattataatcattgataccgttaccgggataaatacggaaagagacatccttataggtagttccattcactgtcgcatctcctatcaattcgatataagtcgcattcggtacagagactgtacttcctttcttatcacgcgtagaagctgcataaccgtcttttccgctggctataatacccgctttgttttcaggcatataccattcgactgttccactagcatccgatgaaggagttaccgtaaaactctgatacgccacacctggtacctggccggtaggttcattacattgcatctgtgtaggaacactacgcagatacaactgctttagcgtaaatgtgaaaccgggctttatcgtataattcaactgtatttttgttaccatacgcgttaatgctactgactgtttataatttattgatatatactgatcatcaagctgtgcgaatatcgcacagctttggtttaccggtaaacctgccgaagtagtaagacctcctgttcctgttccataatttatctttgtatcattgaatgctgttaatgttggaatctttcccaaatcacctgcattccccacaaaacaaagagaactattgagagattctttcaactgaacctcaacctcgtttcctgttatatcggtcagataatgagcgatcaacaaattgcccgaagcatcatactgaccaagccaaagagtttttactgtactttcgtctacaccggaggctttagttttaacaggtaaaacctcagggatagaatctgaaaaagacgaacccaattcatcttcccccgaggtgaatgcaatactacgcgtcacaggagaaacttctccaaccaaagaaaaagtaaaacgaacatccacgtctcgcaacccaatctcattatcgacatttctttccatatcgcccgtacaaccaatgtataaaaaacaggctaatgttaatgacaatgacaaataccgttttgttaaatatattatttccatattcaagctttaattgtttttatcccggacacaacggacatatcgagctgtattcactacattccaatagtcgtaatgtccatctgagaaattttttatactcctttcattaccacctctatgcacagagctgctccaatagtcgttctttttgaatgccgctactccatttttcatcaatgtagtctgattttcgtacatggcatacagttctattaaagtaggtacacgccatcctccgcttttatccttacaatatttaaccgcagctgcataacttgcaaccactgatccccgttcagtcttctcgacttcaactatatactccttagtcaacgtacgagtctgagaattcccgttcagatcagagccttctgatcctgatgatactccgccgtcataattaaatatacaatgattactattgggaggattattttttttcaaactttcaactattgcattatttatagtgaccacattagttcccgcctcttgaatggcttttaccgtaactttacgaaccggatctgcccctactaccgacacaataaatgaatctaagcgttcagcaccagtattagcagaagcagtaaacgtaagttctgcatcaccactgccactagttggtttcacagtgataccattatttgtttcagaggatacagtccattttaaaccggcagtagcagttaccgaaccgacagcactactatttacctctttagttatttttgtaatcgtaccggcagcagtaaacactgatgcttcttgaatcacctcaatatttttgtcaattccattaacatctatatcaaaagatatctttctgtctttcgcgtccggattggctgaaacagctttaaacaagacttctgccggacctttataattgaggattccacttgaaggtacattttcttttccatccactactgccgacaaccagtctggcaatgcgattacccaagctacccccggacgagtcgtcacctgtagggttgtcgttgagtcaatcgcagcatctatagctgccggagctacaatatcgggaaccgtgaccgacacacggggatcagagaagtcgataccacttagggccagattcacgacataaggagtattccgtttcagattataatcattgataccgttaccgggataaatacggaaagagacatccttataggtagtcccattcactgtcgcgtctcctatcaattcgatataagtcgcattcggtacagagactgtacttcccttcttatcacgcatagaagctgcataaccgtcttttccgctggctataatacccgctttgttttcaggcatataccattcgactgttccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagctgcataaccgtcttttccgctggctataatacccgctttgttttcaggcatataccattcgactgttccactggcatccgatggaggagttaccgtaaaactctgatacgccacacctggtacctggccggtaggttcgttacattgtatctgtgtaggaacactacgcagatgcaactgctttagcgtaaatgtgaaaccggactttattgtataattcaactgtatttttgttaccatacgcgttaatgctactgactgtttataattcattgatatatactgatcatcaagctgtgcgaatatcgcacagctttggtttaccggtaaacctgccgaggtggttagacctccggttcccgttgtgtaattgatctttgtttcattgaatgctgttaatgtcgctatctcacccaaatcaccgacattaccgacaaaacgaagcgaacagtcaggagactctttcaactgaacctgaacctcatttcctgttacatctgtcaaataatgagcgatcaacaaattccccgaagcatcatactgacccagccaaagagtttttatcgaactttcatctacgcccgttgctttagtcgccatttctgatattccagaggttatttttgaagactcggagcccaattcaccgtcttttgaagtgaacgccaaacttcgtgtcacaggagtgacttcacccgctaaagtgaaattaaaacagacatccacatccttcatccctgctgttaatttagattctataccattatcgcaacctaacattaatacaaagacaggtatagataaaagaatcaacagattaactatatattttccttgttgcatcattttcacttattaaaatagtattacttaacagttcgaacacaacgtacgttgtatttattattttttgacatccaactccatgagttgttactatcaatttttctattgtaagaataaatgtgtgcattattaccactagtcttcgatccccacaaataatccttatttgcattattatatggactcttaagtccggcattaaacaaatttgtcatttcactatcactaggcaaatgccaatcatcaaaattttctgatactaaattattacaatagttatttgcattagtccaattataatttgagacttgtgtaccagacgaagacacttgcattgttccgacagtacttccagccggcggtgttccatactgtgataccgcaaccacctgcgaataacttttatccggtatcgttaccgttatagaagccagacgctttgccgttccgggatttttcgttgcaccgattgacaattgagtaggaaatttcccacttgttggtgaaatcgttaatccattattagacgcaatagtcaccttccacgccaacccttccgttcctgacaaaaaggccttagtctctcctgctgaagccagttctaccgtagcggcaatacccgtataaacagaggccgcctgagtcacgtttatagtttttgaaagtgttccctgaccatcaccggcctttaccgtgatcgtcccgctacgagcagcatttcctgtattaagcgatgcactatacgttatagcctgagcagtccctgttgcattttctgtgccggaaacaggattcaccgtcagccaatccatgttttttgtaaggttccacgatagcccctttgttgcggtaaaagtaccgacattaccggatgtagcttttgcctccagactcattgaagtagtagatacattcaaaacggaaccattctgagtgatggtagccgtttttccggaaaaagaaaattcctggctacgcgctgcagagcccggatttgcagttatcgccgtaaaccctacagaagccggaccggtatacttcaccgtaccgccggcacccgtcgtatttccatctaccaatgccgacaaccaggcaggtaacgtgatcgaccaatctgctccgggacgagctgtgacctgaatagaggttgctgaatttttagctgcatcaatagccttaggagtcgtaatatcaggaaccgacaccgacacacgggaatcagaaaaatcgattccgctcaatgtcagatttactttataaggagagttacgttttatcatataatcgtttatatcatttcctggatacattcggaaagctacgcctgcataagtgactcctttaacggtcgcatctccctctatttcaatataagtagcattcggcacagtcgcgccaccacatttcccgcgatcggtagtagcaaagcctgcctctccacttttaattacccccgctttattttccggaatataccagtctaccgtagcgccactctgtgaaacaaccccacttatattctggtaagtcataccgctaatttgtccggcaggctctacacattgcatctgaaccggaatacttttaatcgatacgctcttaacggtaaaagaaaaacctgcatctattttataaaccaactggatatgcgccagcatacgctccatcgttacggaagggctatacgatatggaaacatattgattgtccaaatatccgaacatagggcatgtattaccgacagtataggttactttttttacattaaaatcagtaagtttatttatgtggcccaaatcaccggcattagctacaaaacgaagggaacactcaggtgattctttcaactggaaattaacctgatttccggtgatatttgtcagatattgagccaccagtaaattgccggaaagatcatactgtcctatccataacgtacttatcaggttttcatccaccgacaaagcccttgtcagagcactcaccgtatcagatgccatgctctttttaccttcaggcataaaagcgatactacgggtaaccagcgaatcgccatcagatattgcaaaggttaagttcacttttacatctttcaaaccggccgcatgttccccattttccatctcttccccggagcacccggagaataaaagcaggacgaatgcaaataaaaaaagtttcatattcatgtattttccgtttttatagccagacaaacagtattaccagttacctttcaatccatccaagatacccagacacaaacgagcctgtcggggacgttcaggcattgccttcttaaaccaatccgtcgcacttgccggatcgttttccatcaacgacaaaatacctaagttgatccatgctttcggattgttcttcacacggtccagaaagtagcgggcagctaccgtatcggccatactcaaagcagctgcaccagcattcaattgtgcaatttcacaatcagggaaacggtaagcggccagttcatatacctctctgtattgctcagttccgggacggaaagccaaagccaccctcaataactcatcgagggtcagacgttcaggttctttctgaaaggcagtcaacaaatgagcgaaatcaatacaggtggcattttcctctgaatcaaccagtcctgtttccgttagctgataaacgacattcacctgtatccggcgcaagccggcaaacaatgtattttccatatctttccaaaccttccctttatccaggctgcctaaggctttccggcggacatccggctgtgacaggctgtccaaaagcgccatgaccctcatcgcataaggtttacgagcctctgatacagcccgttttaaaccgtcccaatcttcctgcgactgtctgactacaaatatattttccggcaaacgcatttccttgcctaaataccggcacagacgcaatgcccttcctgtcgctaattcctcattcttcgatgtattgccatccggagaagaatatcctgtgacttcaaccgattgcaatgtgacgtttctgtctgccaaaagagcattcagatcattgcatagcccggccagttccttactgttctgtccataagaagcggttaattccacacttcccggtttaaaggatagagaagcatccagcctgcgcacttccgaacggatgatttcttccggtacggatgccgtatctgacttttccggtacctggaaaaactcgatcatctgccggtatacagtttctgcatctacctgtacctgtgcaacaatttgttcacgcaccaatgatacttgtttatcagcaatggtatccctattttccccggaagccgtatgtacggcagaacatccgcctgtcagtacagccaatgcggcaacccatattgtaattacgttattatccatttattctctattatctaatgatttgttattatattgctcctcccatattatcatccgtttcttccactttcgtattccaatccgatatagtccagttcaaagcagaagagttattgtcgaccgtcagcgaaacaacatatgacttacctgcttcaaaagccattgcatccagcgttgcctgcaacgttttttctttaacagccgtatcattctcatcctgatagtcgagggtgacccttactcctatcgacgcattacttttaggtaataccagattggtagcctgggtcaggcccagttttttcggatcatcactagtgggcactgcaacaaagtttgagaatacaacagtcgacgctgccgtcggtgtgatcacctccggctttcccgccactatcgaaccggttgctgccgacattgaactcagctcaaccgacttggctgttaatttttttaatgcgattttcgttgttgccgccggtattactttgaatatcaaccgtgcacatttgcgcacaaacgtttccaacgtaacagtggcattcgatacggttaccggcatccccgttcctatggaggtcatcacatcttcattcctcgacagcccttgtacctgatactttgaagcatccaacgttagcggacgggcaggcgaaattgcatagaagtcataagttcctttataaacataaaataactccggcgtaccgtccgtttttttgccgtcggcatccaccgtgcactgcgtcaatgtgccatccgcatttaccacataagtggcctgggcggtcggggcggtaacagcgtaatctaccggaacattcaacttgccggacgggcgttgataggcaacgacacggactgtcgctccggcaggcaggttctcttccgaggcacgggtatctatcctgttgcccacagcaggtgcctgtacatggagctccacatattcattttcctgcccggtcggttccactacatcgcctgccgtacaggaaatcaacccggaaaaaagcaaaataatccacttgcctatatgtttcattttcattcttattttctatgcattattcggcagctaccgggtctttcaggttatctgtccaaccgacaagcgtaacacttgaaatggtcaacgccttttccgtcaacaggatcgtataaatgtaatggttgcctttcgcccagtctaaatccgtagaagtggtggtagtaaacgtacggtcataagtggcttcatctttcgttccgactttgactgagacatccagcttgcccttatcagccaagccacaaggggcaaccaaggcaaaagcctggggaagaaccgatgtaaaatcggcattggaaccggtttccttataagctgccacctgccggcaggcagtaatctctttaggggtgagtgtaactgttgccagacgaccttcgtcgctagccgccagatcaccggtattcagtacgatatccccttttccggtaaagcccgttttaccaccattcgctttaaacgtcagttttacctctttcacataatcccgatcgcccggagccggaagtccctttgctttcatcacgcgaaaactgactttcgataaagcatgcttcatcattaacgctgccgacgagttatttttattgatcttggtaacgggatcggaataaagataatccgtctcgctggtattccagtctgttacccctccctgatccgtaaaatcgaaggtttgcgcagccgcaaatgtcacaccggccagtttgggggcagatttggcaattaatgtagcctcgttggtagatggcgcccaggcataaacggttccgtcggtatcattcaaatagagcggatcacccacaacttcccaggttagaggagttccggcttttgctgtaaactgttgcttgacagcgtttgtatcataccaggaagcattattttcccttgttacgcccactcctattttattcaatacattaccggttgttccggcactaacatccgtatatacactttttgtttccaggctggcattcgttactcccaaggcaaccaaggctcccccgttatctatttcatttgtttcaaccatcgaacaacccgacaaacaaacagccagtaaggcacatgcgttataaatgatctgtttcatattattatagttttattattttttgttttccgtttcttttttacttgtttacggttagtttggagttacaccgtcgggctggacaggtttagtatatgtcgtttccgtccatcccactacctgtggcttactgaccagcaaacctgcatcggtcacctgaagcgtatagatataatggttacccgattcccaggtgaaagtagaaacctccgccaagtaaatacgatcgttggttgtattatccttagcccccaacaagacactgatcgttcctttcacattcgacacgggagcgaccagtccgaacattttagcagccaaaccggcatagtcggcagtataagcatccacctgccgcagatccgagggagatgtttttgtggcaaacgtcaactcgcctgataaggaagaaataccgctcaccactccgttccccaaattgaagctataagtaccacctgccggaaacaaaggggcatccgtcgatttcagaataacctttttcacaaaatcatttgcatccggtaccggctggccatttgctttcataaacctgaaactcaccttagccaggaaatggcgcatctccaacgaaaccgtattctgcttatgtgagacagacggacgactagccggtttgcccggctctactccatacaagtagtcgtactggctgacatccgaaagcggtgttttatcgtcagcaggtggcgtacaggtctggttggccgaaattgtaccactcagggacggtactcctgccgtcagcgagacattaaacgattcactatcggaagggacggaagcggtatacacagttccgctcctgtcagccaggaaaagcgtgtctttcttcataccccatgtcgatccgttataataaaacaactgggtttgattcgtatcatcataataatcaccggaagaatttgtcaccaccacaccaatacgctgcaactcacccgctccggtaccgataccggtataaatacttttggtcgacaccccgacgttattcacagccaacggcactcgttcctccttattcggttcgagaacatcagtctccatcaccgagcacccggacaagacgtataatgctacaatcccgacagatatgtttaccggatatttcatattattttcttctttttttatttgtgaacaggaagggtatcgctccccgcctgccctaaacggaatgtaacttactgaaccggtaagtttgttgttcctccggtgccgaaatccacaatttttacagaaacgatttccagcgcaacatccgaaatattaattgtatatgtatattctttccctttctcccattggaaagtcacctcattgccggtttttgtctgatacgacctgtctttgtccgttttcgcatcattcgaaccgagtgtcaccttcacgctcaaatctttatcggccgatgccaggggagccaccaaaccgtaagcctgggcagttatgtcatcatacgtttctgcatactcaaccgcctgagccgcttttccggcaactgccgacattgtcagcgtagcaacagccgatgttccatccaaagttccgtccgtcagtttcattgttccggctgaagctgtcagaaaacggttggttttactggtaagctcgatcttctttacataatcgttctcatccggagccgggtcattctcccctttcatgattttaaaactcactttggccagggcatgatgcataaataaattagctttgaagtccgttttattaacggtttgttgagctgcatccgttgctgattttgtggcatataaatagtctgtctggctgcaagccgactggctcaccacatcgaaagtctgagcggcaaccacgttcactcccgtcgcagtcaatttatcggtggctataaccggagtggccgataatgccccttcacctgttaccggagcccaggcatatacagtcccgtcattgttattcagataaatctgatttgtcgccttccaggtggtatccgtatcagctatatttatatcatattgcttatacgaatcctcatcctttgttgtataagccacaaattcgccggagctgtttgttgccgctaccaataccccgacagcccccagttggccggcttcactgccgactttgtcgtaaacagactttgtcgcgatggtcgcaccactgaaattcatactgacacttagcgggataccggtagccccacccaccggatcggttgttcctcccgtatctatctcaacagagttgcatccacacagcgcagccaataggacaacagccaggcccgttttctttatttttttatttactcccttcattttccctttcattcattatattacttaatcgaccgggaactcttcttctccgccggattcaaaatcaactatttgtacaaggtttacatccaacacctgatcggaaatcgttacagtatatatgtattccttaccccgctcccagttcactttcagttttgtctgagcattgccggttttataaatacggtctttgtcggttgtagcatcgttgggcccgatagtgagttccattgccataaccttctcatcctttgtcagaggagcaaccagtccgtatacctgttgagcgacgtttttgaaaccgtccgtttcatcatacacagccaactgcttgcctttccctgtttcaactaagaaaaacaaggtatcggtaggcgttccgccggtcaacgttccgtttaccagactcatcgtcattcccgaaccttgcggaaaatcatttgccgtagaaaacaactttatttttttgacaaagtcattgtcatctatcgccggttgtccttttcctttcctcactttaaacgacacttttgccaatgcatgatgcatatataaggtagtctgcctgtcggctttactaactgtatcctgcaccggagtagcccgaatactcgaattcgtcgaaaacaaataatctgtttggtcacaggtgttacgtttcacatcggtcgcatcgaaagtctgactggcttttatcaccagacctgccaccgtcacatccgaatctgttatcgaaggagctcccgataacgcatccgatccttccaaaggcgcataaccgaaaacgaccgctttgttgttattcaggtaaatatccttgtcggccttccagattaattcgcccgacgtacttccttctttatcggctgccgtataggttgccgacacactgctatttgcataagtagcatattgcccatctgcaaaagaagccagcgacacataaactttaccgatattgtttgctcccgaagttcccacaccatcatagatagcacggctggtaacctctgtcccgacaaatccgagattaacctccatctttacttcttctgctccgggatgattaccggaggagtccggcccctcctccacctccggcatgctgcatgaacaacagactgccgaaaacagagaaaagaccatccccctttttaaaaattgcttaaccgtatccattcagctattataaatcgattacatcatctacttcaaccgattcccaatcagccaccttcacatcgacaacgctcaggccttttttagacacactgaaagtatagatgtagtttttattgggtaaccaaccggtattgccgtcagcatccgtaggtacaggtaaaatagcttccaacgggaatgtattacttgaacccggctcagcaatctggaattccacttttaccgaattttctgccagatcagcgatcggataaaccaatgtactgatatagttggctacagtacgaccgtcttcacctgcaccatatagataagtaacttttgacgccttttccgcagttccgaacggatctttagtaccggttgcacgcgctctgatcagataataatctttcaatgtacgggtaagatcctctcctgtagcagtctccgtatcgataacatccgttgctgtcgcatcgtcattacttattttcattgttgcatcgcctactttgaatacaccgctacccggtgttacattcgagattttgaaagaggcaaccgaacctaatgtcgaagcattcggagttgttcctgtgggagctttcgctaccagatccttatcgtacaaacggaatgtcaccatagaaagcgcatgcttcatcgacaatgcgatgctattgcccggattcgtttcatccgtgttattcggattggcaggagccgtaacaacaccatcggcaccaggattggaaccattatttaccaaacgtccataaccatcatccggtctgaaatacaaataatcgatttcgtcagtcgatatattcaccggattcttggtcttattatccacccaggatgtagtaaacgatttggcggcattagcaaccgatccttctatcgcagttgtagttgtggcagaaactgtaaccggataagtaaccgctccgtcagcaatagtagccttcttacggctggcagttgctgctttatcataaggataataggcaaaaatctttccggggttcttgtccagataaaaaggttttgctttttctgcagtaatactagttggaattgtagccacatctatagccttccaattcgcaccggtagcatctcccataaagcaaatatcatagcccggatttgtgtaatcgtaaccgatcgcaaaattggccgttgttgctgcataataagaggaaatctccgcattagtgacaacaataccaataccgtaagccgtttttgcatagtttttgtcatcaaacgtaatcgcagtgccggttacggctgctttcgttttgtttactccgacattgacacccagtgtcacaggcttgctgacgggctgatctacagggttgtcgatttcactttgcgagcaacttgctgccgccatcaaaaaggtggtcatggccacccaagtcaattcatttttcatctttgtttttattaggtggatctctaatgaaatcctgttaattaataggctgtttttaaagtggaataggatcatccatttcaaccgaggtccagggatcgactgaaacagtcactatttctatttcgctattggtaaaagacatctccacccggtgcgaaaatccggcttgcacgccactttcgccggtagccgcatttttgaataccagggtggccgtatgccggtagccacccggtttctctattccgatccctcccttccgggtcgtaatatgcaatgtcagcggatattgttcggttcctccggcttgcgcaggtatcagaatactgtcttgtacagtcaatgattccgggatagaaccgggagagccggtatataactccaatgccttgccttcgctcgtacaaatagaggataacgaaaatgtttccgaactttccacaggagacagaacgggtatattatcggacaaagtaaaagtctgttgccggtgaatatcttccacttctatcttcgtaatcgcaccccacatatccggctgatcgctgaaacagacaaatttcaactgtgtcagtaaatggcggaacgtgcaagtcgtaattggttttgaatacgatccgctaagcaaaccggttgccatcaaatccgtcgagccgtcggttatggtatagacaggccgttccggcacgtcacctgtccatccggaaccgggataatatccgtttaaccgtacttcccggttatcgtcgggataaaactgcggctcggcaaaagcaataggagttcgtcctattccaccctttcgcacagcgggcagttcctgccacaaactcccctggtcgctacgggcaaaacaaacatccagatccttttcatagccggagttgatcaccgcacgggtggaagtaccgatcgtcccttccagatgtaaggctttcgacggcacttcatgaccgggaccatctgaacacccctgcgacacagacaggacagccaacaataaaaaggccggatatatattcttcatctcctactatttatttgaaagtttcaatatcagttacccggtttaacaaccgtactcgtgctgcttcccggattccaaggtgcaatatcggcttcaatcacaatctcaccctgcgccgaaaagatcaaagtgatcagatgggcatatccttctttcacgccttcacggatgttattgatcgtaatctttttagccgcattcaactgacggggactatccggattggttccatcataagcggtcaatacatccaacgtgatcggtgaagagaccgtacccagattttcttccggatagatcatacaatagccgattacgggattttcttcttttgccgttacaatcttcgacggacagttgaaaaaagagagtgactgcttcgatgcagtgccgttgatttccagagttgcttcagtattagccggaagcacgttcaacttaagattaacaggctggtcgttcaccttaatcgatttaatatcgccccacgacttgatcgcttcggccgaccctacgcatttgatctgtagctgtgccagtttatgattgaagataaagggtttaaaaggattgtctttatcggctgtctgacattcggtagccatcagatccatatccccgtcgataatgtaatcgatcggagaagaaacgcttccgcttactgccggacgcggatatataccgatcattttcgtttgggtacttgaataagaagcatacgtcaatgtctcgtcgccgaaagtaacgagttgattgccttcaccggccatacgagtcccgttataccatttcgtaaagttactaccagtgccttccagatagccgaacatgacatccagtttcttgtcgtatccggagttgattactgcttttgttgctgcatcggccaatccggcgctgacctcgatagctgcacttgccggtgtaccggcttctgtttcgtcattactgcaacttgccagcgaaaaagtggcaagtaaacccattagcaaaaagttattcgttttcataaaaacaagtatttatagattatttactgtaattaatttattattgtgccattgccgctttctccggttttccagtcactgacagaaccggttgccacgatcacaatctcatcccgtccctgaaatatcaggttgatcgaatgggcatacccttctttcacctccagcggagttttgccatcagccacattattaatcaaaatctcgttgctatcagttccatcaacatagtacactttaattttcagcgcatccatcggaccgatcatcaagggggatcctacggcttccagattggttgtcaacacatattgggcaatccccggtacctccggttttaccgatttgtcctcataaacgatttttccatctgcaatcgtcatcgaagaaggatactgcccgtcgatgatttctattttcaagatggctttatcgatgttattgcgtagaaactcagtagtagcctgcacacgaaaattaagttgcgtcagtttatgaccgaaagtgaaaggagaagagacaggagtttgcttgctgccatatacgattccgccatacatcacatcttccgtacctgttttattaaaccgtacgagaccattctcagaagggatattgggatgccaggcagccatatacacatttcccccattcggatacactttcgaattatccaacggaacccaattcccggtactctcctgactggcagtcaacgtaattgtgttttgccaggccggttgtgcagtccaggtaggataaccagaactttcaaaagcagtgatagcggcagtaaacttgtcaccggtagttaccggtgctttggtaattgcctcgctaacagtggcacccaccttaatttccgctgattcattactatccggcaccccgtcattggatgaacaggcagatagcataatagccagaaaggccacatacatagatacttttttcatactttttgttataataattaatactagtgttccgttcagtctataatgccaattccgttattcccctttatccactctaccacggaggcggataaggcggtagtgccgtctgtccggatcgtgaccgacaggagataagaagtaccgggggcggaacggttattttcttcatgaaacacaatcggcaattgcctatagtgtctccggttttccaggctgtcttgcaacgtgattgtcatactaaggtgaaccgccggctgaaccataacggtttccggtatctccgtccaggcagtgtcgagcttctgaagcatatccccgggacggttcactgccattatcaagccgttatctccaccgaacgacaaagacttatcagccaaagacaaagaaacgacctgctttacaccatcgatgactatctcacgcagtttccagcctccggctattcctttttcgtcgagacgtaacctgaaacgaagctgtgtcagcaaatgcacaaatccgaaggatttcgtatcctgccagaacatatctgtcagacaaccgtgttgttcgtcagttgcaataatatcccgctgtccgtccattggataagcaatagtcatacgatcggtcaacctcccttccggagcaaatccgcggagaaaaacagaactgttatcagccggataatacttcggctctgtaagggcagtactaccgttctttcctatatatgctttccaaatctcctgatattttcctgattcatttcctttgacaaaaaatacggaatccggaaaaaccgatacttctcctgacaagctttcagcataagaatgaagtatcagctcttttttactttcaggccggttaacatccacctgtccggagtcattgtcatccgaacatccggccgccccccccaacaggtaaagcaacatcatgctacgcaacatcccatatctaaaatccattcccctatacattatatatatattctttattacctatcaattgccgggagcatctacttcgcctgtcccttctttccagccaacgttggtaacgaccataccgttaatctcatcgtatgctatttcgagatcgagaacaatacgaacagccagtgtcgcttcaaaagcatcgttaataacttccgttatattcgtaaacgaagtaatctccttatcatcagatgttttcagtataagatagatatcgacatcggtatagctgccttcatctactccggatactccaaacaggttgagggaagagttgtaaacccctgttgcacccggctgtgttccaaaagccatggaagccggcttgtcaaacaagagttttccggtagggatatggatttcagaagaaatcccggttaataggcctgtcaaactctctatccggtcctctcccccacctgttattttaatattaagttctaatattctgaccaggcttaccggaaacagttcctttgttaccgccctgaaccctcctatgttggaaagttcatcccccgttccgtacaaatagccgggttgtgcgacctgtatatccgatgatttcatggcagatacctgacgggctattccgcaggagttttcatatcctttgttcatctcaagcaatacactcttatcatccgcagcacaaaccactatcccatagttgccggaaggcaacgtcccttcgtaccccgatgattgtccctgacgaatgatcggacgatctgcaccgtctttataaaaataataagtcataacagagggatgatctttatcctgccagttcagcgacaagcggatttttccattcttcgcccagtcttcgtcggtcaggcgataagtacaagccggcaaaaggactatacatacgattgccacgacctttatacattttatatattgctgttttttcatcttagctttctccttatctggtttgaaaacgatatactaaactgatattgaaaccaagcataaagcctgtagacgaaaagcgcgtttcaagatagttctttgcatctgcattatcataacggtatttctttccatcataaacagagcggtaaccggccgacaggctcgcttccgtacaaaaaccggcaccaagcgggatcaggcaacccaccgacgcccccaatgagataaaccgccccgtacgaccatacaaattatccggagctttactgataagatctcctcttacgtcaaaatctccatattggaagaacaacccggtattcaaccagcgatattcgtcgaccgccaacggccagacctttggagagagagtaacagacgatatcgcccaatgatctttcgttttatctttatatgcaaagtctgcatacataccggccagtgccaccgaccaacgtctgccaaaataatattccacctccaggttcggcataaacgccccggtaactatttgttcatcgcctactcccaataacatggaaggcgccaccgttgcccagggaagcagatttgtctttatagccagtccttgctccatcaaacccgacaccggtttctttgtcttttgcaacgttttcttttccggggttgactttcgttttacaactaccggagcagcttcttcttctataaacgattcttcttccggcggatcttgcctggcaatttctctctgtacccgacgtgccgttgttatgacctgccccgtttctacagtagccagccggtaatcttccaattcggaacgatcgaacaacggatcggttattacgtaaactttacgctcataaccaccagagctaccccgcgaatatagattcacaaaaggcacagctccataacggttcacggcagcagcaacagcattcggataactgctttcactgcagctgatttcctgattggcaaaccacggcagcggagcatgtacctgatagacatgcacctggtctaggtaatcgccactacggtctatatagaaagcaatacattcgtgagggatattcagctttgacttaagataagcccgtatacggctggcacgaagggaagcttcattgattacggtttcgtcagtattattatacgaacttacatgagctacgatcaacagatgatattctcctcccagcagtttagtacgggaagctgtcagcgattcattcatatgttgaagataataggcattatcaccgtaatcgaccagaaacagatccttctcttcaacgaaagaaaacagaaacgactccgctttcgtataagatctggttgtctgggcatttgctcccggcataaacaagctacaaagtataaacacacaaagtacagtctttactatccttccggattttcgttgtttcatatcatgcatactaccactcagtttaattatcattgttacttatttcccttacccttatttatgtaataaggaattaaggcaaaaaacaacttctttaaagaggggattttgtcattttcaagtcacaaataagagaggattgaagtcttttaaaggtcttttcggggaaaaacagacagcaatgaaaatgtttttttcccaatggatattaaagagatggcagccccaccccgtctcatgtatcactacaggaaaatatccatcggattagttaaaaacaggctattatgcaaatttatgttaaataaatatgtttattttatcaaaagaataacaactccttgtttttcattcgcattctttctatgtttgtggagtcttttatcacattttattatttatacatgatctaaaggactgtatatgagatgaaaaagggcattttaccttattacataaataaggttatctctcacgctcggagtatattctctataccactggttactaaactattagcctctcctactttatcagcatcaaaagcagtaagataaatactcgtcatcttttcagaagaatgtccgagggcttggctaatgatagcaatcggtattccacggtggtaagcctcagaagcccacgcatggcggaagacataagtagttaacggatccaccaatcccagttcgagacgaatctgatccaagtgacgattttcggtcgcaagacagtatttatactgttcgtgcgtggcgccttcctgcaaaacgggaaaaagatacggtgcatcggtacggctgtaacggtcgaccagcaactgcatacccggagaaacctccatctggatcaatacattcgttttctgacggcgatacgacagtactttaccgccttcaatcaggttatcctgtgtcagatgcacgatatccacaaaaggcataccgcaagccataaaagaaaacaacgccatatcggcagccaactgtttctccggctcatccttcaaatccagcgaagcgatatttttgatcacgtcgaccggtacggcccgcttttgcgtatcctcccgctttaaacagatacccacaaacggtgactcgctcggccgccctttccaacccaaacaggcacggttatacatcgcacgaagattgctgagatagctgttcacactattcacccgcagccctttcttacgtagccagtcctgaaaattatgtaccataacaggggttactgctttcaaagagagttcccgaccgccattaaagcttttgaaatggttccgcacagcccgatacagatcggccgtgctctcgttaccctcagaacgtttttcctcttcctgcagcttcatttcatcataaaacactttgtttttcatatcatttcaaattaaaaaaaacaaagatataacaattgcagggaataaaagttattcacctcagattacaaaaaagacaacaaaaaacggcttttatctttcataaagtcctaattttataattttaggcaacagtaattcacctccgacaaggcgtttaagctctatacatggccttttttccacccaaattcattctttcctaaaattcatcacaatcatttttttaatcatcacaatagtttgaataaaccattgcaatgactcccgacacttatcacaataaaatcagcaaatcattgcaatcatttttttaacacgcctccccaaaaggtctgaaccacaaaaaacaacctcccgaaacgacaaaatcatctaatcaacacgctggaagtcctttccgaaccggcattatccgactgacatatcgaaaccgattagccgtcttaactatcacacatccgataatcattacaatgatcttttctccctcttgccaaacgttactataaaacaacaaacatactcaatccgctatttcttaactccggctcagacggatataacaatcccctaacctctacgctcacgtacagagccaagaaatcaggggattattgacaaaatgacaatttgatagaacttcgtgactaatcaatacttgagttcaacttataaatgcaactttttgggtgcggataataagcaataaaaacatttatttttcagagaggaaaaagttactaaaaatcagcgacatgtacaactttttactcatatttatcaacttaaattaattccgccaacgggtttaaaaaaatagagttatatttgaacgtgataattctcagaaactagtataagtgttaaccaaaaaaattaaatgattatgcaacgaaagaaagcgatttattctttcaaatgctgcaaggtagggatactttcagcattaatgtcactttgtatgacagctgtctttgctcaatcgggcactgttaaaggaaaagttttagatgaactaggtgaaccgatcatcggaacaaatgtagtagaaaaaggttcgaccaatggtactgtcacagatatagacggtaactacacgctcacattgaacgacctgtcgaaagccgttcttcagttttcattcatcggttataacacaacggaagaagccgtaaaagggcggaagacaattgatatcaggctggctccgtctgttgttaatctgggtgaagtcgtagccatcggttacgggacacagacacgtaaagaaattacaggttccgttgccaacgtatcagaagagaacttcaacaaaggcgtaaccagggatgcctccgacctgttgcaaggcaaagtagccggtctgacaatcacatccggctccggtgacataaccaaaagttcaaccatccgtctgcgcggaacatccaccctgcaaaacgaccaggggccgctgatcgttatcgatggtatccccggaggtgatatgacaaccgtagcaccatccgacatcgaatcgatatcggtgctgaaggatgcatcttcagccgccatctacggttcgcgcgcagccggcggtgttatccttatcaccacgaaaagaggttcaggctcgaaaacacagatttcttacgatggatacgtggccatggatcatctggcaaacaaacccgacctgatgaatgccgacgaatggagagcatacgccaaagaatcaggacaggacgccagcgtatacgaccaatacggggccgataccgactggttcgatgccatgacccggacaggtatttcacaaaaccatgccatctccctttccggaggaggttctaaaagtaattaccgtgcttcgttcacctatcttgaccgcaacggtatcatgcgcgacaacgacatgaaccgttacagcttccgtttccagttccagcaacgggccatcaacgaccgcctgcgtatcggtttgctcggatcagccaccttaacggatgcacgtatcccttacggagacaatttcgtgttagcctatagcatgcttcccgtttatccggtttacaatgccgatggttcttatttcaccaaagtaaatacggagtacgaccagggaaaccctgtgcaaaaccaggacctgaacagaaaagatatgaataatatctatttctatggcgcaggagatatacaattcacaattatcgacggcctgaacgtgaaagcgaatttatacaaaagccgttattccagcgagttcagccaatatgacaactctgaaaccaagcagggacaaagcaataacggatatgcacaaaaacggaaccgcacctggaaccgcaacctgatggaatggacagccgactacgaaaaaacattcggagccgccgaagaaaacaagatacaaggtatgataggttattcctgggaagataacaattattcctcattcacttcacagaaccgtaacttcctgaccaacgaccttggagcaaataaccttcaatcaggtaccggcctgaaaaccggtgacgtgtcgtcagacaaaaactcctacaaactgatctccatgttcgcacgcgcccattacagctatgccgaacgctatatgattacggcaacggtacgccgcgacggctcttccaaattcggggccaaccataaatggggtacattcccttccgcatccgcagcctgggggatctcgcaggaatcgtttatgaaggatgtcaagtgggtaaacgatttgaaattccgtatcggctacggtgtaaccggtaaccaggacggcctgcaaccttataagagccttgaattatatggttcggaaggtatctattataatgacggcagctggcagacggcctataagatcaaccagaatgccaaccccgacctgaaatgggaatctactgcgatgctgaatgtgggcctcgatttcaccttgttcaacagccgcctgaacggtaccatcgaatggtataacaagaaaacatccgatatgctgtacaattacgaagttccgactcccccgttcgtgtacaataaaatgcaggccaacgtaggcgatatgaccaacaaaggtatcgaaatcatgctgaacatggatatcctccgtaagaaagacttctcctggaacatgtcattgaacctggcccacaacaagaatgagatcaccaaactgtcgagcgacgtttatacgaccagccgtctttacacaggcgacccctggctgcgcggcggttcaggcgttacctcacatgtcattgaagaaggtcgtccggtaggacaattctatatgctgatctgcgaaggaatcgacgaaaacggcaaatacatcatcaaagacaagaataaagacggacagataacagacgacgaccgtgattattgcggcgatgcacaaccggatcttacattcggatggaacaactcattcagctggaaaagctgggacctgagcttcttcttccgcggttccatcggccagaaagtattcaacaacccgcgtgccgcctatggcaacaataccttcctgatcggtaccaatgcgctgaacgatccgctggttcatcagctcacagagtcttcccgtatctgttcctactacatcgagaatgcttccttcatgcgcctcgacaacatgtcactgggttatacgttcaacacaaagaaaatcgactggttggataaagcccgtgtctacgtagccggacagaacctgtttgtaatcaccggctacaagggtgtcgacccggaagtagagatcttccgcggagaaatcacagatgcggatgccggcctgtctccgggtatcgaacaccgccagttcttccctaaatcaagaactttcactttaggcgttaacttaacattctaacttactaattaagcacattcttatgaaaaagaaatcattgataatatcactcgccggagcaactcttctcctttgctctatgccctcgtgtatggatctgggcgaaacagtgtatgacaaagtgcaggccgaccatttcggcaagaacgaagcggaaattgcatccatagtcgggccggtttacaggagcctgaaccaatatgtcccttacaacttcatggcattgtccgaatgcagcggcgatatggccattgtcccgacccgcaaagggggcgactggtacgacggcggacaataccgcgaattacacatgcactcatggacagccaacaccaaccagataaagaattgctggagcatggctaccaagtccatttctacctgcaacctggtctacagcatcgttgaaagcaacactttcatcagcgacgaactgaaacaaagaacattggccgagatcaggggcgtacgcgccatctggttctacattatgatggataactgggggaatattcctcttatcaccgactttaaagacaccagtctccccaccgtgacaccgcgcaaggaagtctataatttcatactgaaagaacttaccgagattaaagatgtcttacgggaggatgtcagtacggcttcttacggaaaattcactaaaggagccgcttatgcactattggctaaaatgtatctgaatgccgaagcatggggtgtcgacgttccacgctggcaggaagcagcagatgcctgcgatgtagtgatgaagctcggctataccctcgaatcggactggaaagccaatttcgcaagtaacaacgagtcgtctatggaaaccattttcccgatttgtttcagtgcaaacgaccaggatataaacaacacggactaccgtaaccgactgtttgcctggaccctgcactacaaggacaatctggttctcggactgaaagtgacaggtgacaacggcgtctgcggacagccggattatgtaaaactgttcgacgatgccgacatacgtaaaaaaggttctttcctgttgggtgaaatgatcgacccggctaccggaaaagtaatcattacagctcacgaccgtccattgatccacacggaagacgttacgatcatcccgggaacggaacgtgacggtacagcctggggagatgtgaaccaggaagatggcggccgtgccatcaaatggcctttcgacaaatcgactgtagacggcatagaaaacgacttcgccttgttccgcctggccgatatctatctgatgaaagccgaatgcctggtacgtatgggtatagacaacggagaagcgacccgcctggtcaatgagatccgccaaagagggttcgagaattcggagcacaattatgcatctgtcacactcgatgaaattgccctggaacgtaaactcgaacttgcctgggaatgttactcccgtcaggactgcatccgcttcggcactttccagaatgcccgtttcctaaaaccggatacgaaaggtgaagattacagaaacttgtttcccatcccgcaggatgcctggcaaacgaatcaaaacctgaaacagaatccggggtatccggcattctaacaaaacacagacaacgcggaacacgtgaaaacccatgtattccgctataaagaagttatctaacacacgatttttcgagatgattttgccgttatcggcaagaaatcggtatatttgcatctaaaatatacacatttcttgccgataacggcaaattacgtttatgaaatattactcagtcagcgaatttgcaaaaaaacaaaatcttccggaaaggacagtacgtaactattgtgccacaggaaaaatagctggagcttttctgaccgggagaacctggaatattccggaagaagcagtaatctctgattctaaaaaacagaaaagattcagcgaaaacccactgcttaatacactcaaagaacaaaaagatatgaaactgaacggaggaatatattaccgtgttcaggtagatctcacctataattccaatcatatcgaaggtagccggttaacccacgatcagacacgattcatctttgagaccaatacgatcggggcgacagacgaaatgataaatgtcgatgatataatcgagacaaccaaccatttcaaatgtatcgacatgattatcgaaaaagctaaaaccaaaaagttgacagaaactttcataaaagaactccattatacattaaagtccggaacttccgatagcaggaaagactggttcctggtgggtgactataaaaagctccccaacgaagtcggagggaataaaacctgtccccccgaagaagtgtccgcccagattaaaacgcttctggcggattataatgccataagcaataaaaccgttgaagacgtcatcggcttccatagagaatttgaatgcatccacccctttcaagatggaaacggccgcgtaggacgcctgatcatgtttaaagaatgcctgagtaataacattgtacctttcatcatagacgaagatttaaaatggttctattaccgtggtttgcaggaatgggataaagcacatgaatatcttgtcgatacctgcctgactgcacaggataaatttaaaacaatgcttcaatacttcaagatcggttataataactgatagtaacactcaattttgtcaatcataattgacaaaaacatattatgcggcattttcgtccattataatggatgaaaatgttatatttgcaaaaaacatccattatgattgacaaaaataactttaaacgagattacattgaacgtcctatttatacagcggtaaaacttacggctgtataatttgattacgcaagaaatatcctcttttgccggattattcgaaatgcagatggggattggtcgaaaaacgtgccattcttccacttaactcccctattccgtactaaacagacctaagtcgatttgcagtttttagtgggatatatctttgtcatgttttcgagaacaaacaaagtattatccattcacattcaaaattaaaagattatgtcactaaagtatcgtttagtagagagaaacaacccgggtaaggacaaagacgaaaccccgaaaaaattgtatgcacagccgaataatattaataactttagcccaataataacaaattcaaaatgaaacaactacttctatttcttatcttatccgtccttgtgatttcatgtacgagcgaaaacgatggattattgaaaagtaaatacggcaattttatttctctggataaaacagaaatgaatattaatatagatgagaatacgttttgctcataccagacattttctgcattcaaagaaaacaataacgaagaagtactcttcgcttacaataactcaatgcattcgcttgatattttcaacccgaatgataaaagtgtttctcatattcaattagaagcagaaggcacaaatggcatcttgaataacgtatcaggcatccatattcataagagagacagtatctggctttatagtcaaggttttctttatcttgctgattctcgtggaaaagttagtaaagctgttcaactccccttccctaccggtggttttacctgggtagagactaatttttcaatggctaccagcaaattattttatcatccgacaagagaatccatattctatctgacagtgactccaacgaaagacagtgccgattaccttgtctatgaatattctataaaaacagactcatttaaaacatatcctcttaagggcggtattcttgaaaagaaagccggtaaaaatttcggttggatgcaattccccaatgtcacctatactcagaacaatatactatacaatttccctatcaattcaaacatatacaaaatcaacatagagaccggaaaagaatcttctttcgggggacaaagtaaatatacatccaatacagcttccgagttatgtatgccttatagttttcaggacgcagataagcacctcattgaaaacgtccatttttttgaaatccaatatgagcctcagaaagacatctattacagattacacctcgataaagcagttttctcaactaatacccaaagcaatttactctatgatagtaaagatctatatcttaccatctttaataaaaactttgaaataatatatgagaacaaattggataacaaaacatacagttatcataatagttggggaatcttgaataataagctttttattaataaagacaatatattaaacgataacaaagaccccgactcctttgaaatggttctgtttgatcccattctttaaatcgttatcacattagtctataaaaattaatcacatcatctatttgcttctcttatttattggcctgaccgtttcatgcaatcaggcaatcatcttccgatcaaatattctatctgagcgataaagtatggtgctgtatactagacgatgaaacaaacaactgcaatgttcaattacaaattataaatctgaaataagattatagcaagggtaaacgaatctagctatatatatataattcatattttgttctcatacaattattcatttggcaattatcaaatgaataaagcatatatatgtttctttcgtttgatatatgtcaaacgaaagaaacacgattgtagaatgaattatccaatgagataattttatttgtaggacgtaataaaatatcattataataaactacgccagactggatattattcgtatttttataatttattttattagagatatggaacctctcttataaaccattaaagaatagacttcaaatgaatcgccacaattcaatcattcttaatataatcctggtcatggtaattattcttttgaccggatgtaatgatattgagaaaaaacaattggctttagcccttcaaacggctggaggtaatcgtcaggaactggaaaaagtactgcaacattatcaaggagacgaacagaaagaggctgctgccagatttctgatccggaatatgctggggaaattttatccggaaggaaaagccgttgatgaattccatctgtttatcgattccgtataccaaaccgaacaggaagaatatgatcagcaaacgataaataaatcataccggacccaaaataacaatctacaaggttttgcaaagcaacaagcagacttgcaacaattaaatgcggaattcctgatcacccagatagacgaagcattccggatatggcaaaaaccctggaacaaacatctttctttcgaagatttttgtgaatggattctcccctaccgtgttggaaatgaactgccggaaatatggcggacacaatattacaacacatttgcccaattactaccggacagtatatcaacaacactggaagcctgtatagcaatcaataacgaactgatcaaacaaccgatccacatcttcactgattttcctaaacctgccgatataaaacccagtagcctcattcatataaaattcggtttgtgcggagactatacgaatctggcgatatatgccatgcgctccgtcggcatccctgtgtcaaccgggtttatacctcattggggacgtggtaataacagccattcgtttaacctcctatatgacgaaagcggcaactatcacgattttgccgggggagaacaaaatcccggcgatcatctaagacgttttgaagacataccgaaagtatatcagaaaacattttccatacaacaaaattcccttatgatgacaaacacgtctaaagaagaaattccaacctttttcaaaaatccttttatgaaagatatcacaggacatttcccttttattcaacctcaaaccgtctccattccgttgaacaaaggaaatacccataacaaatatgcccatctatgcgtattcgatccgcaagggtggtttccggtagattgggggaaaatagccaaaaagaaagtgaccttcaatcatgtcggtccggatataatctatcaggtttgcagttatgagaataagagcctacggccgttaagcgcaccttttgtggtcgattctaccggaaaagtcaccacccatgaatgtcaaaaagaaaaggcagatctgtaccttgaacgtaaataccgtacccccatacatttggccgccatacctccggcatttgtcggtggaaaattccagggatcggattacgcagattttcaaatggcagaagatctgttcacattcacagaagctcccgactttaagtatacaacaattgaagtcaatcctaagaaaagttacaaatattacagatatctgtcctctcccaatattcgtgggaatatggctgaattggagttctatgaaccaggcagccagaagatactaacaggagaaattatcggaacagatattaccagtatttacaatccacacgccactaaacaaaatgtatttgacggcgatccactcaccttctttcatacccgcgacagcatgagttgggcaggtctggcattttcaaaacccacacgtatcgataagatccggtacatcatccggaacgatgacaacggcatacggaaaaacaatctctacgaacttttctacatagacgaatccggacaatgggcttctgccggacaacaaacggccgaccaggatgatttgcttatatacaaacagattccccaagggactttatactggctacgtaattataccagagggaaagaggaacggatatttacatacgaggatgggaaacaggtttggtggtaatctctccatacaacaattactcatgtaacctgtttgtacattcagatgagagaagttaatacaattttagttctattcctgataataataacagggtgcgatggtaacaaataatcaaacagtcaaaataatgactccagcgcagttgttatgccggatactttcatcacagttgatgttagtaaaaaatgtcattaacgacggagagatttttatctttagcagaaatggcaaaggtctgagaaagattaacaaaaaggggcaaggttctgaagaatatatattcaacctaagtgttttcttagatgaagataagggtgaaatatatgttgacgaagttattagaaacgtattagtatatgattttcagggaaattttataagaagtatccacagagacgatgtcaaatggattaatgcaactagttataactctgattatttgattgccagagaatcaccttctgtccacattgagaaaaagacggataatcagcaatttgttcttatatccaaacaagacggaagcattgtcaaagattttcgaatctattttgaaaagaaagtagagtggggaataaccaaccacgccggaaatgcgggagttgctcctcgtccttaccctatcgtcccttaccacaatagttggttgctcatggaaccttcttctgatacaatattcagaatctcaccagattttagtttgatccctttcatagcaagaacaccgtccatacaatccatgaaaccggccgtatttcttttaccttgtatctttaccgaccgttactatttatggaaacagtaaaaatggatgcagactttctaagaaaaggggggagtccaaaaacatatttggcgtatgacaaaaaagataatactttattcgaatacactatactcaataatgattttccagaaaaaggacctatgaatattacagtacaggaaacgaccaacagtgaaatcgcattttggcaaaaatttgagcccagcgaacttattgaggcttataagaaaggacaattgaaagggaagttgcagcggaactggaagaagattcaaatcctgttattatgttagtaaaatataagaagcaatagccacactattgttgtacgccattttttactgctaaatcttcagggttcgaaataagcatctgataccctgtacttctgattgattctatttgaataaaagaaagcggtttcaaatgtgtccgcaagttacgaattgtactcgcaacagcatcccggtccgatttggatagttcattttttactggtcgtgccaaaatatcaatacaaatcctttcataagttagtttatattgttcggcttttataaaacaacggaataaatttaacaaattcccagtcaaacggatattcacatcttctctatagcacaaatcaccatgttcctcatcaaagaacaaatctttcgacaactccacccatttaattgtcttatcctgaatcaattgactaggtaattgctcttccttttcctgcaatttttgttgcagttgtagtaatttttcttgtcgctgttgcagttccagccgctgctgctcttgttgctgccgtgcttcaagttgttgtaactcttgttgctgtcttaactctagtcgttcttgtttttgttgttgctcctgctttttcaacttttcttgctgccgttgcagttctagtctctgttgctcttgctgccgttgcagctctgcacgctgttgctcgtgttgttgattcaatacctgccatttttgctccagttgttgtaactgcaattcttgttcagtaagcctgtgcatctttttataccagaaacaatacccaccaataatcgcaccaaataacaaaaggcccaaacccgaaatcatccacataagataactatgtctccaaaccgttccaaaagggtacttgatataggcttgtaacgtgatatttctatcaggattttcatctctccgataaacaatgagttttaagggaaatgcctttttataaaaagtactgtctaaagaagtatcaataacacgaccattccgtatgcaacgaatagccgtctcggccttaattttatattctaaaagtgtcgttcgaaagagactatccaaaaagaatcggctggaatcacgataaaaaaggaaatcctgatcgcaccattcacttttttctgcccatgatatttcatttggggaattcattggattatagttaccaaattcccgttctatttttatttttttttctttttgtatcacttctgcaaacacaagagacgactctgaacataatttattttgctgcatatggaaagcactccataaccaccaaccaaataaaaaagtcagaccgacacaactcaatatcatccaaatcttttgtttcatatctaaatcgtttcattttactctcgatcactgactcagttttctgacaattcgctgatatcaatactgtaaatcaacaaattaacgccacccctcttctatttttctaaagacagttgcctaagtcaattttatatatacttttgcatcacacatcttattgctattaaagtagtttcaagaaacaaatatattaaaaacaaatttaacaaatagaacaaatgaaaagaaagactattaaatcaggcatcacccttctatgtttatttggaggtatgtatttttactctactcatcagtcagaaaaaaaggtattgagtgatctggcatttgaaaacatcgaagctttagctctatcagaagaagacccagatgaaaactttaaatgttatggttggggcgacgttgaatgccatggaaagaaagtcgaagtaaaatatggtggcctcagataaaaatcagaaatgaagaccctcctatacatattacttataggaataagcacattaatctcctgcagtggttcacccgatcccctctaccctcggtatacgacttttcccgatgagaaaacagtaaccacgcaggagattactattgattctgtctttttccgttacccttatcgggtatcagtaaaggatagtatcgccattattatggacttacataatgataaccattacttttactctttcacttatcccgactggaaacccatagcccctttcggcaaacggggagaaggtccggaagaaatgctttccgccgaaatgttccaattttgttcatccgattccatttggacactcgatgcaaacaggatgcagatcacacgttgggcagtttctcccgctgaaaaaacagtatcccgtgtagaagaaataacattagacaaaagtctggttcgctcactggacttttaccggacagattcagcctttctgatcaccgactatcagggagatttccgttacaacaaagtcagccataacggtaaaccaatcaataaaattggtaaaatacctaccgaaaccaattacaaacaagatatacatccagccttagcacaggcttggcgtagttttacagactacaatccgcaaaacgggatatatgcaatggctactcaattaggggaaaccctcgaaatatataacctgaaaaaccaaacacataatattatatacggtcccggtggagaaccgcaatttaaggaaaaagggggagaaggtattcctatcggtataaaaggctttatggatatccaggttaccgaccggtatatttataccgttttcgatggaatgtcatggaaagaacgggatgaattttaccaacgcggcgaagcagccccaaaaggaggacattacttatatgtgttcgacacagacggtaaccccgttcgaaaatacacactggacaataatattttcggcatttatataaacgaagcaaccaatacatgtatcgcgacatgtgtagaaagcgataatcctatattaacattcaaattatgataaagcaaattctatttatattaacaattctattaccgatcttcttttcctgcaaaaacgagcagaaagagaaagaaaaacacattgtgcaattggtgaacgaatggcaagggaaaaatattatattcccagaaaacctgatcttcacacgctatctgacagacactacagattatcagattccgcaatccgattacaaggtattaatatatgtagactctattggctgtaccagttgtaaactgcaactacctaagtggaaagaactgatcgaatacaccgattcggtaacacaaggaaagataccttaccttttcttctttcatccaaaagacataaaagaaatacgttacctgttaaaacgtgatgagtttgatcgcccgatatgtatcgatatgaatgatcgactgaacaaactgaataaattcccggcagatatgacattccagacattcctgttggataaagataataaagtagctatactgggaaatccgatacataacacagctgtaaaagacctttatctgaaacagattaccggaaaagacaatccgaacaaaaatctgttgaaaacaattgccgaagcaacagagctagaaatagacttcggcacattcaagaaatcagaaataaaagaggctactttcgaaataaaaaacactggggataatcccctcgtgatagtggacacaagtactacctgcggctgcacggcagccacatatgaaaagcatcccgtaaaccccggaggatcccttcgggtagggatcaagatgacaccgaaggatacaggtttcttcgatgaagtcataacgataaagtacaacagtatgaacaatcaacctgtcaaagtaaagataaaggggaatgttcggtgatcgaacgaaagggagtttgttgcacgacggcaaaattgtacaaacaaactcccagagaccccaaaaggaggtgtatcatgataacttagctactagtctttcgcactctcttagagaacaaagatatgaagaactcgcaaaaaaacggcaaaatttggataaataaagtaagtgtttggtattgaggagagttaagccaaattcttctatgcctttccaaatcgctaaaatgcaggataatgaaaggttaagagaaagatttgctacttatccgttgccttttttagccccggataatccggcaaaataacgcttaaccacctgcggttttaccgttcaccatgcaaagaaccctatattttgcccgtaaagataaccgtttttttccgtttttcatggaaatacaggttatgttaccggcatccggggttttattctttgttccgctataattttcataactgtaaataactctatatcaagtaattttgcaacataaaaaatagagttatgaaacagacggatgtaacggttacgttctacctcaaaaagagcgaaatgaatgacgagggacattgcccggtcatggcgaaacttgttgtcggcaaattttcagaagcggcttttagtgcgaaaatgtccgtacccgctgcactgtgggcatccggacgtgccacgggtaaaagtaacgccgcgcgggaaatcaaccggcaactggacgatttgcgagcttcagccattgccatttatgacgaactgtcagccacccgtgagaatgtaacggctgaagaaataaggaatctgttgttggggacggctttcgggcaggaaaccctgttgggttatttccggacgttcatcgaacatttcgagaaacgtgtcggcgtgaaccgggaaaagggaacagcgcaatcttaccgctatgcttgtaactgtgtggctgctttcatccaggagaaatacaagttgtcggatgttcctttcacggccctgaaccgttcattcatcgacaactatgacctctacctacgcacggagcgccgctttgccctgggaactatcgtgttgcttgtcacacggttgaacacgattgtcggggaagccatcgcggaagggattatcactgccgacccgttcgcgggttatgaagccgaacatcccgagcgggaacagaaataccttaccgccgcagagttacaacggctgatgaccacacccctgcatgacccgaagctctaccatatccgcgacctgttcctcttctcctgctacacgggtatcccttacggggacatgtgccgcctgacgacggaggatctggaagtggccgaggacggtgaggtatggatcaagaccgcccgcaagaagacgaaaatcgactatgaagtgccgttgctcgacatcccgttactcatcctcgacaagtaccgggatatggccccggaagggaaactgctgccgatgtacagcaacaacgaactcaaccggacgctgaaacgtattgccgccatttgcggaattgaacggaagctcgtctttcactgcggacgccatacctacgccaccgagatcacgctttcgcatggtgtcccgcttgaaaccgtcagtaaaatgctggggcatagccgcatttccacgacgcagatttacgccaaagtgaccgatgacaagatcgacatggatacccggtctttagaggaaaagattgccggccgcttctccgtagctatttaatctatcattgacaatcaaattcacaacgattatggaaacgaataataaagagataaaacgtcgcagcacgttctccctgctgttctacatcaaccgcacgaaagtccgcaaggacggaacatgtaaattgttatgcaaggtaagcatcgacgccaagtcggccccgatcaatatcaacgcgtttgtcgatccatcgctctggaatccggaaaccaaaagggcgaacggacgaagcgagaacgcccgaacggtaaacctggcaatagagaaactgaccgaaaaaatcaccggacattaccgtcatattcgtaaaagcctcggtttcgtgacggccgagctggtcaaaaacgccgtggaaggaatcgggcagaaaccgttcaccctccttgccttgttccgcgagcataacgaggagttccgcaagcgtgtcggcgtggatcgcaaggaagaaacttatgaaagttacgagaactcctataatattttagcctccttcgtgaaaaaaaggaaggaaaaggaggatgtagcgttgcggagccttgaccgggagttctacgatgattttgaaatattcctgcgtacagatcgtgaaatgaaacccaagacagtacacgagcatctttaccggttgaagaaaatgaccaagcgggctgtcagtcagggtacactccggcgcgacccttacgggaagctgcacccggaactgccccggcgcaagagccgccatttgaaactcgaagacctcaaaaaactgatggaaactcccgtcggtaaacccaacctccagcgggtgcgggactggtttctcttcgctaccttcacggggttgtcctacgccgacctgaaacgcttgtccgaaaaagacatcacgcagtcggacgacggaacgtactggatacacatccggcgccagaagaccgaaacgccctcggccatccgcctgctgaacgtgccgttgcagatcatcgagaaataccgccacgagcgtaaaagcgacaggattttcaacctctattgccgggggtatctcatcaagctcaccagagaactgggacggacatacggcttcgacatgacctttcacaaggcgaggcacaatttcgggacacatatcacgctctcgctgggtgtgcctatcgaaactgtcagccgcatgatgggacacaagagcatttccaccacgcagatttacgccaaagtgaccgaccgcaaggtggacgaggacatgaaacggctgaaagaacagaccaaaggccggaaaataaatctctacgaggaggacgaaccggaaacggcagatattataacggtaaacggttgaacagtataacaaaaattgataaatttgtatgactatgacgacaagagaacctatcagcattgaaaacgggcgggtggaaatccacacgccggagaaccgtgtatggctcacgcgccaccagattgccgacctgttcggagtcttcgttcctgccgtggggagcaacatccgctccatactcaaaagcggcatactctgtgaggagagggtttaccgccgggagcgcaaccgtgacggcggtattgtcgagctgtattcgctcgaaatgatcgccgcgctggctttccgcttaaaatccgggaatgccgaagccttccgacggtggcttgtccgaagggccacgacgaccgctgtcgtctggcagctccccggcatgaacacgatattgaactgaaaaagaagaacggccaacgttttggccgttcttcttttatacccattcctgtcccccgatacatttcttccgggaatcttccaggaatttctgtatctcggattccatgtatagtaccttgccctgaatcaaataatagggaatgatccgcgccgtgcggtattcctgcaatgtacgcctgctgattttcagcagccgggacaattcctcgtcggtgacgaaccgctctcccttgagtgtccggcctccggaggattccagtttatccagtgccttgccggccttttccaaacgccggaagagatccgccacacgcggatcgtgcttgtcgatgaaataatggctcataacgcggcggtattaggatagtgcgacgattgcagcagtttcccgacatcttccggtttgtagaagattttgtgacggatgcggctgaaaggcagcaaccctttctcccggtaggtttgcagggtacgtttcgatatacccagcacgtcacagacatcctggttgtccagccattttttcaaactcacgtcctcctgcctgcggcataacgcctcggcttttctttcaatggcttccacgtgccctgccagcgcgtcgaaagccttcacgtccatacttattatttccatgttctgtttcattttttgtttcccggatgcccaaaagtacacaaatggacagtatcttgttatcagccagtggcatatggacgtatccgtcttaaaagtggcagcgagtggcgccacgtccggcggaaacgatcctccgccgatacgggatcggcacgctccgatacgccaatcgcccgtgaaaggaaatgttcgcgggcgatttatcattccatgcagggtgagccgtgaaccgactttcgcgagcgttcacggcatatcgttttctccccgtttctctcccataaccttttcctctcttttttttcatgccgcggagcgcggtatggaaatctgttgtcagtagcaaaggtagttacggggctcacgctgctgcaagatcgggccgcggggcggtttgccgcaaaatcttcctctttccctgcgggcgagcgtattttccgacaaaatcttgcagcagctatccccgacaccttttgatgctaccgaaacagattccatccataccggctccgctacggcataaaaaaaaagtcaaaggttatgagaaacgaagagaaaaataaatggaaacagaaatcctccaaccttccacttggcataaaggcaaaggtcgggttggcggtaaaggtcggggcggtggctttgggcttccacgtgtggggtatcgactttatttgggtcgttttgggcttcacgttctgttatgacatcctgcggggcattttctcctgccttgtttctctcgtggctctaatcggctttttctatttcctattcactcacatcttctaaatttttacaggtatgacaaagtacatttcattattcggagcgactaccacggacacgcaggtgcaggtagtcaaggaaaaccaggttatcatcggtatcggtgcgggtgcgagcagaaagcgttacgtcgtttacaaggtggaacacaccgcccgtggctacgtgtaccacatggtcgataccgaaacaaaggaaatcagccaaacggacattctgcgacccctctcgcaaacattcggtatcggcaggtactacgacgacgtgaaccccgagttcatggacgctttcgaggtggctttgctcgtgaggcaggcggaagagcaagccacggcgcaggccatcgccgccgccaaagagaaagccgagcatgaccgcatagcggaaataggagcgcagaggttacgccgcatcatgcccgaaggggtgcagggcgtaatcatcgccgaactcaacgaaacggaatacactgacccctcttacgagtgttcgaccacccgaagcgtgcgtaccgtcattctcggcttttcggccacctcccgcaacggcttcggggagttgagaaaggcggcggccaatttcccgcaaacggcgcacctctccgaatacgaccccaagaacgaacaccgctatcccgttttcacgctcggcaaaagtccgaaatacgggtggagtgtctgcaaactgacccactacacccgtgaagggtacatcgacaggctggcatatatcgcaggaaacgaggagaatatatgtctgcccgagccgaaagacgaaaaacgggcggaacgcactgaaacgagcgtgcaaggcgggtttatcatcgtggactattccgagaaggcgatagccgtattcggggacaccaagcccgtcaaggacgcccttcacgcattcgggggacgcttcaacgcacggctgacgcatgacgggcagaagaaagcgggatggattttccaaaagaccaaagaggacgaggtgcgacggcttctcggaaaggacgaataaatgttgaacacggggcggctcgccgccccacaataccaaaaaatcatggcacaaggaacagattatttcaaactgacgatacagaactatctcgacgcacgggcacgggaggacgaacttttcgcaccccgatacgccaacccgaaaaagaacattgacgattgctgcactttcatcatcaaccaagtacggcagagcggttgcaacgggtttgccgacgaggaaatatactctatggcactccactattacgacgaggaggacatcgacatcggcaaacccgtcagttgcaaggtagtggtcaatcacaccgttgaactgaccgaggaggaaaaagccgaggcacggcggaacgccatacggaaggccgagagcgaagcctacgccaagttggcgaaagccaagtccaaacccaagaaaatcgaagataacaaactaatgcccagtctattttagttatgaaaccgagaacaaaattccaacagaacgtcgtggcggcaagcaaacacctgccgccgcttacccccgcacaaatcgaatgggggtacaagaactgcatcgagcatatcggacgccgcacgccgaaaggacttatcacctgcaccgagtgcggccacacgtggcagagcgaaaacggagaactcacggacaatctgttagggtgcgagtgtccgcattgccacaccacgctgaaagtggaaaccaccctgcgccgcaagttcaacgattacgagtatttgtgcatcgtaacccgctgcaagggttttcaagtcctgcgcttcgtctatatcgagtgttgggcgaaagtgggacagacgcccgtttacacccatatcgaagccgtacagcggtggattgcccccgacggacgctccgcaaccttcgcacggctgcgcccgatgggcttcttcgttcacgggtggagttggtcgagcgcattggaactgcgggcggagaacgacgggaaatacaacatcacgcccacacgcatctatccccggcaacggcttatccccgaactgcgccgaagcggctacggcaaacaactccccgatgtaacccctttcgaccttatccacctgctgctctcggagaacaaggccgaaacgctgcttaaagcgggacaaacggcactcgtgcgatttttcgcccgttcctcccgcaatatcgcagactatttgccggccatccgtatcgccatccgtaacgggtacgctatcgggaaaccgacggaatggtgcgactacatcgacctgctgcgatttttcgggaaagacctgcataacgcccatttcgtgtgtcccgcagacctgcccgcagcgcatgacctctacatggctaaaaaacggcggcacatgcaaatggaacggcggcaggaggaacggcgcaaggcgttggaacaggaagcctcgtttgtcaaagccaaagggcggtttttcggagtggagttttccgacggggaaatctgcatcagggtattggacagcgttgaagccatacggcaggagggcgaggccatgcaccactgcgtgtttaccaacgaatactatctgaaagccgactcgctcatactctcggccacaatcgacggcaaacgtatcgaaacgatagaggtgtccctaaaacgcatggaggtcgtgcagagccgtggcgtgtgtaacaagaataccccataccacgggcaaatactgaaactgatgaaggggaacatgtcccttatacggaaacgaatgacagcataaaaatcggggcggcgaaagccgcccgcaaaaacaaaatagaatgaaccaaatagcatataaattcgtgtcgtgggatgttcccgcactcgaaagccttgcaggctcaaaagcgtacatattacgcaaacggctcaatgacgggggaacgctcacccgtgaggagaaagactggattacccgtgaggtaaaccataacacctatttcaaggactccattccgcttttagggtatcgtttcaactttgtcgatgtactgaaaacattcgtggtaaagcagtacgggcattacacggaatacaagggcgtggacaagacgagcatacgctccatgttgtacggcagagtggaaaggattgtcgaattataaaatcggggcggcgaaagccgccctacaaaaaaacataacaatgaaaatcatctataaaagctacatggcacgcccgctcaaacccttcggggagtgggattgggaagttcgggaagcagtcaagaccgcccttgcgctcgtcgaggggaaaaacgggttcaaaacccattccgagatatggcgaaggtgcaacctcgtcattaccgtgggacacaacatctacaccacgagtatcgagatacgaccacccgagcaggacgtgatacgccgtaggagcaactggcataacggctacgcctactactgcaacggcgtgttctgggcgaacatgagcagggttagagtggaacttgtctgattaaaaaatttcggggcggcaaaagccgcccgtaaaaagcgagaatatgaaaacgaatgaagtaaacaaggaaatctcctatgaaacgctgctcgtaaccttcggcgagggtatcgggcggctcaacaccatgttcgacgacccgcaggtgtggggcgttgccacgctgaagcagtggatcgacgggtatgaaactacgcgcttcaccgaaatcgacgaccgaacggcggttatcacatccgaatacaacatggacagcgtgaaggaatggctgcaaaagaacacaccgattatcaacctggaaaaacgataaaatcatgcgcaagtacaaattattcatcggctaccggctgctgggagagttttccggtatatgggaagctaaaaatttcgccgctgaaagcggcatgagcggaattttctcgctcgtgggagaaaattaccgggacagttggtacgaacccaaaaaacaagaaaagaatggaaacaaagattaaagacatcacgggagcggaaataaccgttaccgacttaaaagaggcggtacgccaatgccgggagtgcctcgcaagtccctacctgatgccctcggggcataccgtgggggaaaaccatgcctacatgttgcggcaactgctcgccctgcaaaggcggaaacgggaacacggcgggcaacggccgtgaaaatacgacgcgaaaaaaatcggacgataacaaccgtccgatttttttgtttcccgtcaatcgaccgccgtatggtcgcccagcttcccgtgcagttcacgcccgatatgtccggcaatgccacggggagaaatttcagagattgaaccccacccgccatgcgtgtatatgcacgtcttgagcggttcggtacgggaaaggtagaacagatagccgttgcggagcaggatgcccacgaacaccgagccgacctcgatgtcggcgatctcgtcaaaacgtatcttcccgtcattgtataatactgccgtgccatccgcatcgggaatgacgaacagatcgtcttccatgacaatcccgtgcaactcgattagcgaccccaggcattcactcgccgatacccggtcgtaatcaccctttacctcatttgtcgatttcgtttccatatcgcttttctttaggttcagacaaataccatacgaaaaaggcgtgagaatacgttaaataccggcattgaggtacagccaagcacccatccactcgatagataatttctccccacgccgctatcgcatacgcttgacgcatatagacacgacgatgaagaagagaactacccattattttgcgagcggattaaaatttggctgttttcaatgccccaccataatgtgttccttccgtatgtaaatcgcccggcggcacgccgccggaggattcgattgcaaatataacgatttcatccgggtatcggcgacaacacgtgcgatttttaacaaccttcctgccaaagaactacccgccgtcctacaatttcggcccccgggcgggtttgcggggcgcgaccttcggctgcgccttcttctccctgggcggttcgacgatccgcagtttgagtttctccgtcttacggtcgtaacgcacctcgcagcagtcaatctcacccgcaaccgacgtccacacgttgttcacacgcaccgcgccgcccgagtagagggtcttgtattgttcgtattcgagcggctgccgcaatttcgcgtccacctgacggtggaacgaatagatattacgtccctttgctatctcgtcgggaacgtaaacccgcaactcgggatgggtggcctcggcatagaggcacagatccgccgtgcgaagctccctcggaacccactggatcatcctcgggtcgccccgcacggccgtatcggccacgagcggcgtgatggccgtctggggaatgtcgtacagcacccccgcatccttgcgaacggcctccaacgccacctcctccgttacaagccggcggttcaggtgcaggacactcatcaaccggtgtatcttttgcgggtcgtcctgctcgcggaacacctgcaagaccagggcggggtcgctcaacgcgctgataaccgagaaatcggttttgtccttcccgtaggtacgctcgaaagcctcccggctcatctccggcgtccgggcttcgcgggggacgcctttcaggttttgcgggttctcccgcaccaggctcatgtatagatccgggcttttcatgctctcgggcaggtgggcgatggcatagggactgcgccgtatggcctccatgcacaactccggcgttttccacttctcggggacatattgcaggtagctcccgtcgtgcccgacggcccggcggcacatctcctcgttcttggcgtggtcgggaaggttgtagaacagctccggctccagggcgaagatctcccgggccaccctcggcgtgacgtgtgccgggttcatgtgctgcaaaaaatcgaaggtcttctcgtaattcgtgcaatagaaccccaacgccttcatgtgtatatcctcgaaagggatatagcggaggacacgcaggtcgtcggcacggatcaacgcccggttgcagacctccggcgtgagctgttcggggttgaaaaagcggatggccaggggatcgcgctccagcgccatcccgcacagacggtcggttttcagatgcttcggaacgtactccagcgccaggtagttcgaggacacggcggcctcgcagacccgttccgtgcgtaactcctccggcacttcatggagcaggatgccgtccccgctgacggcacgcaggcagactgcctccgtgcgcagttccaccggcacgagcgaaaggcaggacgcgtccatccccacgccgtgaagggccagttccccggtcatgacctccggggcaatggaggcgaaaatctcgaacttgtccacgaacgacatcccgaattttttcagcccttccaggcatatatcgggatacggaatgtaagggagtatcttgtaatcggcactgtccaccgctttcaacgccgcacggcatatttgcggcgtcctcaattccccgggaacggcctccagcaccaggccgttgcgcttcacggccgccatgcacagttcgggggtcttcaacccctccggaacgtaatacagcgcgtagctgttgctatcgacggcggcacggcacattttcggtgtcttcagacggtcagggacgaatttcagtgtttcgccccggtggccggccgcggcaagacaaagttccggcgttttcatcgcttcgggaacgaactcgatgttgaaagccgatttcttgatggcgaaacggcagacttccgccgttttccgatcctcgggcagcgtctcgaaaaggttctcacgccacgggttctcgtacacccccgtatcgagataggctatatctattctctcttgctctgtcatggttttcagtatttatggaaagcgcccgggtgacgggcgcctctcttggttagacatattccgttatcgttccgtttcctccgtcccgttctcgctctggaacgtgaaggaggtcttcacgacctgacccgtgttgtcctcgacatagacgtcgatggcctgctggtcatcgctgcgcgatgtgtaatagaggcggaacacctcacggtcgagcggatagcggtcgttgggcaggaacaccgtaccgtcgtccatcctcaactcaccgcgcccgtcgggctggaaatagcggatcgtgtaacgcgcgccgtcatatctcccctcccgcacgagcgtgcagcggatttcagcggtttcaccaacggagattcgcttctgaacgggcatcgtttccagagagaacgtgtacgcctgctgtatatccagcccgttgtcgcaggatgcgcataaaagacccagggcggcgatccagaccgccagggccaatatctttttcatctttttcatgtcgcttgcaagtttaatggattatgaatttcacgcccaggccgaactgcgcgtggaaatgtcccgttgtagtgccccataggatacgctcacgccccgtcagcgagaggataatcctgtcggtcaggtacgcatcgacctccagcgtgacggccccgccatagaggaaacggtcgcggtggcggagcgtagagccgtcatagagccgcctctcgccccggttcacgctctcgtaaccggccagcgccgagccgccgaggtagaagaaaaaagtcctggacgggtcggcgaggaacttgtaatagtaacctccctcggccgtgaactgcgccaccgggatacgttccgacttgtaggggtaataacggttcaggaactccgcgccgaacacccacttgtcggcattcttcgcgtagcggctcatggccagcccgaaccagtagcccgtttcgctgcggctgtcccgggtatagaagccgtcggccatgcctccccgtatttccagcccgcgcatggcgggcagggcacgctgggcgtgcgccccgtccgaaaggaggaggcataaccccagcgtgagaatgaatatcgcccgtttcatatcactttacctttaactcgttgataacacgtgcgcgcaccaggtcggcattctccaccgtgaaagtctggtgtcgcccgccttgctgctcgtgcagttccacgaccagctgcttgtcgtcggccagcgtgaacttcgggagcgtgaagaccatgcgctcggtacgcttgccgccgatgacctgcacgttgttgtacgcacgcacgggccatacgacctgctcctggatggccgtgcgtttggccaccttcttgtccgtaatcttgaacgtcaggtagtccacgttgaaaggcacgttggaggagtttttcagttggaggtggaaataaagcaggtcgttatgcacgtagatacctttgaggaggtattgtaccccgaaacgcttgcaaccgatatgcttgatctcgcggcggtcattcttgtaaatggactgcatgatcagtttgaccagcagcggagattcgcatcccaactcctgcaaatagatgtccagcgcgttattggggcggtttaccgcctccccgtcatgcaggaagtccgccatctcgaccgacagtttcaccggctcgtcggcatacttgacattgaagctgtaataggccccgtcctcggtaatgaccgaaaggttgctctcgcgcgagaaatcacgcagggccgcctttacacgcagcacgttttccgtgccgtcggctttcgccgccagaagatccgaagaccccagatcgacgtaacggatggccgaggggaaaatcacatgaacggtcttgctgaacgtcacctccagcgcgtagggcgggataacccggttgaaggtcagcggacgggtaagaccgtcgtacaaatcgcccgtggagggcttttcctgcgcgtgggcagcgaacatgcacccgataaaagcgagtgccagaagaatctttttcatactcgataaatttttgattgttgataaaaatggattttttcagtggtgtacggaagtacgtcgtttgtacccttattgaaggggcgggagcagcaggacgctgtaaccggccttgagcgtgaccttgaccgagcgcatcttcttgctcacgtattgcgacacgccctggatggcgctgcgccccaggtcggagagcagttgcgaaccggcatcgtccgtgatcgtgatactgctgcccatgcccgcacccatattggcggcgatctccttcacggcattgagttcttccgaccccggcacgggaataccctcgttgccgttcgtgtcatagaccgacagatcgaccggaacgaccgccccgccgtgctggacagcgctgaccttgaccgtcagccgttcgccgttgatcctcgccgcccccgttacgggcgtacccgaggggatgagcagatctcccgccatcatcggttccagcagccggaaagtaacctccccgccatcggtgagcgtcacggtttgctgcacggcggcacggatactgttgcgctcgggctcgcgaaggtcgctccccaccgtgttgaaaccccagttccggggcttgacgaactcacgggcgaagaccgaatcgggcagcggggcggcaagcagcgacacgatgttacggcgcacctggcgcacgggctgcacggaagccttgccggaaacggaggctttctgacgcggggcttcaggggcctgaccgccattcatgtagcgggcggcgatctcgtaggacttctccagcagcgccacctgctcctcctgggccgttttctgcgcctgctgttcttccaggcggcgttccagttcctcgatgcgggcctgcatctcgcgctcttcccccgtttcaccggcggtctcctcgtagaaactgcctaactggcggttgatgtcggcataggcggcacgggaagtccggaaagctcccgacgaaccgccggcagggccggaagacttatccggcacggcagcgggcatgacgggctcttcctcctcgtcctccatcccgaacgcgaaatcctgcaaggagcgcatcttttcccgctccctgcgccgcatctcctcctgcacgtaggcatcacgcttgtccgagaggataccctccgattccggggtcggcagctccgtgttgaaacccgccgaaggctcctcccgttctttttcgccgggggagaagatcagccacatgcacccggcaaaggccaggaaaaagagcgggaagaccaccatcttcttccgcatctgtatctgccggggcgtgagttcctttttccccgcctccggctgtttattctgtttttcgttcgtcgtcataattgaaatcttttagatgttttacactgtcggcctcctgccgttgtcttaattccagctccagccgctcgatatgccgtatctgcatccgttccccggctcccttgccgaagcggtagatggaagacacggtaaagtagagcgacaagacggaaaagaacaagagcagcgtgaggatcacgataatccgcttatcgggcgagagcgccccgcaagcgcggcgcaggtggtcttcgacccactccccgaaagcctttattctcttctttgccatagccttatctttttaatgtacgtaaatcgcggttctccagaatctcgaatttctccatgatgaaaccctgcgggttattgtccgaacgccccgagttgatcagctcgcagcgcgtgaccagcgaacgctcggtgatgttgctctcgcggacaatcatttgccgggcataggtcatggcccggtagggataggcgttgaagtcgcacaccacggagtccacctcgatacgctggctgatgttccccgacaccacacggttgtagtaacctttctcctgcatgtcctggtaataggcgaaggcgctcttatcgaccaggaacagcgcgcggttgatgttgctctcgatggccgcacggtcgggcgagagggtgaagaacaactcgtgaaaacgccggatatgttcgcgcgcctccacggggcggttctggctcaaatcctgcgagagcgccagcatcagcgacttgcccccgtccaggacgtagatcttctcgcgctgcttttcggcgaaacggaagctcgcgaccacgctgaacacggataccagcgcgcacaggcagaggaacacgataccgaaaagccgaatctgcctgaaacttgtttcgatgttttttaatgacttgaattccattgtccaaattgttatgaatgattattgttaccttgtgttgccaggttgcgcccgttgggggcactgcccgaagccgggccaccgccgccgttaccggaggaggaaccgccaccgccgcgacgcccgaacgtgcggccgatcatgttgccggcgataccgcccgcgacacccgtggcgaatgccccggccttgttgataccgcccatagccccgccggctccgcccgactggatcacccactcggcaacggtggggatcgtgaaatagcctatgatacctataatcaaaaagataatatagacaccgctgccgctgtcgggaatgtagttggggtcttgcagggccaggacgtccgcctggagcatcaacgtctggatcttggccagcaccgcggagaacaggtcggcgatgggaagccaaaggtacacgctgatatagcgggaaatccagctcgcgagcgtcgagtggaagccgtcgtaaatggagagggcgaacgacaagggccccagaatcgacagcacgactaaaaagaatgtccgcagcgtgtcgatggtaagccccgcggcgttgaacaacaactcgaagaagtcccggacaagctgccggaaaccggccttgatgtcgtaccacgtgcgttcggcccacatgctgataatctcgcccaaatccgtgatacccatatccgcaagccgttgttcatacacctcgtcgtccactaaccaagccttgccctcgcgcctgcgggcctcggcttccaaatcgtccttctgttgctggtatgcctgcaaatccaacgtctgcccctccagtatggcgtgcgtgccctgcaccacgggcgacatcacggcgttgatcgtccccagaaccacggtgggaaagaacatcacgcacaagccgatggcgaaaggccgcaggagcgggaacacgtcgataggctccgcattggccagtgccttccatacccggtaagccacgtaaaagagcgcacccaggccggcgatacctttcgccaccccgatcatgtcgccgcatagcggcatcatctcctgatacaggttccggagaacctggtgtaaattgtcgaaatccatgactgcctccgttttcaggttaccaatatctgtcgttcgggttcccgtaaagtgccagcacccggtgcgcgtcgcccttttcgcggccgcggatgaaggacacggagatggtcttgcgcgtgtaatagcgcgtgaggttgcggtactccagcatcttcgtgtaaacctgatccaccacgtccatccgctccttgtccgagagcgagaggccgttgccgccggttatgaccgtcttgagttccgccaccagcgcgccgccctcctccagcagccgggcgtaacccgccgagatcgccgccagctcgtccaccgtgaagttcgggtctgaaaccatacggttgaatcccgaggtgtagatttccgtgatctcgctgaccatttcgagcgtcagcttcaccttccgggcatccttgatgatgttatgcaccgatttgagggcgtcgtagtaagccttgctctggttataaatcttgatactctcttgcagcgacttgaccatgttggtcgccgtggtcgagctttgaaccgcgctcttgatgttctgaacgaggttcgacgggtcgatgaccgtccactgcgcttttgcctggtacgtgaagcaaagaagccccacgaacagcgttaaaatcaatcgtttcatccttttcattatttaattcgtgaatacttgggcggtcattccgacgcccggtaataatccccgtaggcggagagctggagcacctcgcgccccgcatcgtaggccagggcgacatacccgtagaggtcgaagtaacggatgcctccccaatacttcctcacgggacgggagaagcgtgtcccgtccttgtaagacacctccacgtaaaaaccgccgccccggcgtcccgggttgcggtagatgcgaacccggggagaacccgagcggctttcccactcgcccgccacctcgtacagcgcgaagtccaaacgcgccgccgtggggtctgatccgatacacttgcgatacatggcctgccctccctttaacgtttgccctcggcgagctgcctgatcgccagttccatatcaccgcccagctcgccggcaagccgctgcacctccactttctccgtttcctcggtcgtgtaggccaggtactccgggacgctgacctccgtggcatagaccgccgactgaacgccgcccagaccgatccagacctccttgtatttacgggaagggtcgttggactggttgatcgagagaatctgcgccttctccttgtcggtcagccccaacaaggactgaatcgcgtcgaaacggttcatgaacttgcgctggtcgagcaggatcttgcagtccgagttgttgatgatcgcctccttgaccaccgggctggaaatgatgtcctcgacctcctgcgtcaccacgatggcctcaccgtagtatttgcggacggttttatacatataacgcagatattcagccatattggccgtagagagcgccttccaggcctcctcgacgatgagctgtttgcgtacccccttgagccgtctcatcttgtttatgaaagcctccatgatgatgatggtgaccacgggaaaaagctccttgttttccttgatggaatccacctcgaagaccacgaagcgcttcgagagcaggtcgatgttggcccgggagttcagaaggaagtcgtagcgtccgcccttgtaatactgccgcagggtgatgagcatgttgtcgatgttgaaatcctcgcggctgacccggatctcccgctcctccagctcgcggcggtagtcgtcccgcaggtactcgtagaaactgtcgaaacacggcacgatattccggtcggcgcggatacgctcgatataggcgttcacggcactgcccagctcgccgctctcggtcttcgtgatcttgtcgtcctcggttttccagagtgtcagcagcagcgtcttgatgctgtccttcttctccacgtcgaaatagtaatcgtcggtgtagaacgggttgaaactgatgggatgttcctcggtataggtaaaatacacgccgtcctcacctttggtcttacgccggatcagctcgcaaagaccctggtagctgttaccggtatccaccagcacgacatgcgtgccctgctcccagtattggcggactaaatgattcataaagaatgacttgcctgaccccgagccgcctaacacgaatttattcctgttggtaatgatcccttttttcatcggttcgtccgagatgtccaggtgcaggggcctgccgcttacgcggtcgcacagcttgatgccgaaaggactggacgaggatttatagttggtttcctccgtgaagaaacagaccgcgggctcgatgaacgtgtagaacgattcctcggcggggaaatcccccgcattgcccggcatacccgcccagtagagcgtggcggcgtccacggtgttgtggcgcgggcggcactccatcagagcgagctggctgcccacatcattgcggatatgccggagctcctgcacgtcgtccgaccaggccagcacgttgaaatgggcccggacggattgaagaccgaacgagtgcgcctcgttgagatactggtcgatgtcgagtaggtcagcccccttacgggagctttcccctctaagaaccgtacgtgagagtttcccctcatacggctcaagcaattcaaaacttttatttgtaactaaaagccggctcatagtaacttccatttatttctgttagtaattcggctgcaatggtcatgtattaggactttcgcctttctactgctccctgtcatttcagtaattttccagggagtttcccgtgtgatgtgcttgccacacacagggcaacattgcatttgctgattccacaggcgatagatatattgcttgccgtctaagtgtgcaagcattcttcgggtcttgtattgatcgaagaaatctttccaatcggcatcatatgggttggcctcactgcggattttgatatgtcgctttattttcgtatccgacaatctcacaagagtgtggtatttatccactttcctgttttcaagcggtacggcaaaagtccagcttctacctcttacagtgtgataatacttgttggcaatccatcgtttaccttttttgggatgtcttctgcgagaccatcgccatagtttgttgaaaatttgtgcatctgttttacggaaagtttccgatgcagaacaccccttgtagtagttcgcccatcctctaatgactgggtttagcaatcgtatcaaagattgttgcttagaagacttgttcttgtccactatttcacgaaccttatctaaaaatctctttcgactcttcttggatggttttgtgataaacttgcctttatattttctgatattgaacccaagaaaatcaaacccttcttctatatgagttatcttagtcttttcttctgataaggtaagccctcttgcttgaagaaactcaatgactaatggtttaacatggttctccaacaactccttactctctcctgtgataataaaatcatccgcgtagcgaacaagatttatcataggagtatagtaatttttcttcgagcggtttatcggaaagctatcggcaagcagtttttccagtccgtccaaagtcatatttgcaagagttggggagatgatgccgccttgaggagttccctcctctgtcggaaaaagttgcttgttgaaaataaatccacttttcaaccatttacggagcaaaactttatccatagggatattgtcaagcaaccattcatgactgatatggtcgaaacaacctttgatatcaccttctaagatccattgtggggatgtcgtccttgccaggtcattgaagcattgttgaacggcatctgccgtgctcctttcttttctgaaaccataagaattggcatcagccgttgtttcagctacgggagccagtgccatcagatacaatgcctgcatagcccggtctttcatagttggtatacccaatggtcttaatttcccgttactctttctgatatgtactcgtctcagaggttggggtgtataacctctccttttcagttcggttattgcacacactttagcatctggcgttttccatgttaccatatcgacgccagccgttttactcccattattggaagttacacgtcttaccgctaatgctttagcgtaaaacgagtgggtcagtgtccactgcaaggctttgaccttgttgtggcgaccctctttttgagcctttacaatacgcgcttgtagcttttgaaccgcagcttcgcatttgagccaatttatactgtcccatttgctctgcgtttggtcagtcgatgcacacgattttttaatttcgttcatttgcttttctccttttaaaagttctaaaagtttcttgtaaagaatcacctaccgcagaagtcagcctgctttcgcagcgggatgatgtttcaatccctattcaccccattacagggtggcattcgctttttctgcaatcctatacccgcactccattcggcattccttacggtctgcttacctgtcattggcaggagaaatacgggcttactacgttccgtgcaagtaacttataagtgggttaggttctgtctattacaccggcagtactctgttcgtgtattcccagaatggagaggaataaccgactgcttcccttttgggctgaagcctatcagtatctttggcttcttcaaccttacgacgtttagacgacagttcgcttacgctaaccataccacccaagccaagctccctgactgtatgatactaacagccattgtctttccctcacggttctgactgctcctttcggaagggctaccttgtctggacagctttgatacagtatattactattggtgcatctgtccataggctaccgttgacgaaacaacgggttaaatctaagtttaacaattacttacacagcgacgtatcgcacccactccttgtttatctggttcccgcgggagtagcgggaaagggactgcatgttacgcgcacgtttctcgaacatacgcaggttttcgtcgctgtcttccaggaacacgtactggttgtaaaggtggtcgcaggaaagcagaagccccacgggggccgcgaacgagagcaggcagtccgaacggtcggtggaaagacgctcgtaacgggtgtccgtacccacgcgccccggcaggtcttccgtgtccgagagcgtgtgcaggcacacccgtttgttacccacgcgcagaacctcggcccccagctcgatgtcctgaagagaagtcgtctccgagagcgagagggaaaagtaccgttccagcaggcccggacaatccgccgtacccgtgatctcgtcccccgtgaggcggacaagggtcaggaaacccgaatcgttcagaatacgctcgaactgttccgccgcctccaggaattttgtcgccgattcccggtttacctctttgggaatgatgttgccccggcagagggtcgagaagtctgaacgcatgtgcatacgctccctcgtcgttttcgtcaggtagaggaagcaggcgtgggtcaggaacggacgctcgttgaaatgccgctcgtaactgcgggagaggaaactcatgtccccctcgcccgtggccgggcggtaacgctcgcggatgaaccagtcctgcttgtgtaccacgctgtattcgggcaagaccttcagggccttgcaccaggcggcgtggatcgcctcgtactcggcggacgtgacggtgaacagctccgggagttcgacccgatagacgaccgttatgtccgcgtccttgctgatgatacaaccgccttccacggccaggagcgggaacttgctttccagcgtggtggctttcaagatgtttctcatacgcggcccccctttcttttcagcaaccggcgcagggacttgcggttgagcaggtagcggggatgccggcgcgcggcgagcagcttcatcagcccgtgttccccgtaacgggcgttcaggcggaaggtaagccagaccagcaccgaagccgccgcaacgccgaaagcgatacatacccactgatcgacccctgccatgtagaggatgacgaacaccacgaagacggccagcaggccgcccgcgaagatgaagaggtactgcgccttcaggccccggaactccacgctcttgccgattcccttgttgattccatattccataattatttgcatgacaggttggactacaagaagaaagagcgtaggatcgtcgcggcgacaatcaggaaaatacacgcgccgaaccagctcgcggcggtcttcgacgtgtcggggtcgccgctcgaaaacttgttatagaccttgatgcccccgataaggccgaccacagcccccacagcgtacacgagtttcgtgccggggtcgaagtagctggttaccatgttggtagcctccgtaatgccggcgatgccgttgccctgcgcgaaagcggaggagatggcggcaaagagaaatgccgccggaagaagaatcttgttctttctcataactcgataatgtttgaattgtggcgcggggatggataggccccgcaccgggttaaacttcttgattcggattttttcagtggttcgaggatagcctcatgcgctacccgtagtctttttctttcatcgtgatgtcattatggggttaaacaaactcacggacgtcgaaacccgtgggaaccgaaccctgcggagatgggctttccgcagacctctcggacatacgccggtgaaaggccgagaggtaggtgtcgatcagggattttaccctgtcgttcccgtcggggcggcccgaaacgatgacctcgaacatgtcggtctgtttcaggcccaggaggacacgtcccgtttcctccctttgctcgtctgttgaaggtggatcatgtaccacgtggcggtaggcttcgcccatctgttcaaaactaaccccctgggcaagcgagcggcccaaaaggggcagctcttcggtgtcgtcttcatcctcgtcataatccggctcctccgcgtccgcatccgggaaagattcatcgtacagcggaaagtcgatttccagaggttcgttaggctccccctcgggagcgacaccgaacacttcatccaggtcttccggcggaatctgccgggggtgttcgggtacattcgtgggcacaaatatatcggctttttccgtaactttttcagtttcagattctacggcagcttgtggccgggagtggcgcggggcgaggacaaagcggctcctgccgatgatctcctgccggcagggcgtgtcttcggcaacgatcccgtctgccggttcgttacgttccatccgccgcaggcggaaaaacgcccacaaggcataccccacggcaaagaggggcagcagccacaacgccccgttcatcgctcctccgctttgggttgccgggaggccacggcctcacgctcctcgaaaagccgctcgatggtttcccggttatcgtccaggtgcgccttgagaaccttgtccacgtaggccgtgatcgtcacgtcgccacgaccgatgacacgggtgatctcgcggatacgctcgtgatacgacggacgtatcttcacgtgcttgttaccggcgaaaggcagccgcagcaggcagatgtaacgggccaggtactcggcctcgggggtggggacagtccccacggcgacctcccccgaagggccgtcggggacgataagggctttcatcctgcgccggtagcggcacacgcggaagatgaagggcacggcgacgcaaaggacggccgccaggataacagataaaataattgctttgtctgacatgatggattgtttttaataggttgtaaatattgggttcataactaaaaaatatcggagttccgtttcttgtagagttccgaaatttcctcctgataggtcgcgaaatgctgctccagcacattgtccaggtaactatacagcgagagttcgttcttaccgataacctgcactatccgggttatacgctcgtgaaactccttgcggatatacaccgttttgccgcttcgggtattggagggggcgttccggataaaaagacgctcgtaatcctggcctttccctcttcggcggcggccctcctctttcgtagccggcgaggcggcggcctcgccggacggttccgatagagccgatgcctcctcctctttttccggcgtgtaaggatgtaatggccggtttcggcttttggcctggctgatgatgaaggaagcgtccaaaccgtcgtcatgttcttttccgctcataagatcctactttaacagttcgatcaattcatccacgagtttatccaggttgctgccccggatcaaagaacggtctgccgggaagagcgtggaacggaagacagagcgacggctggcgttctgctcacgacgaaaacgcttggtgtcaggcaggaaggtcttcagaacaggaagccccagctctttcattaccgcctcgtaaacctgatataactctgtcttttcacgtccgtccaccatgttccatagcatatacagccctttcatccgggacttctcgcggcccatgatatgctcctttaccacaaccgcgtaattcagggtgctttccatgacaacccggtcggcactgatcggggcgacgagataatccattccggccagggaatgaatcagatcctcgttattgatcgtaccgggaaggtcgaagaacacataatcgaaatcaccttgcggcagaaggtagtcggcatcggccaacgcctctttcgtgttgctttccacgacaggataggctttcttttgaagccgggtgaattgttcgtaagctaacctcttgtaatgttcgtcttcgagggcaagcttcaggtcacgttcccgcatctccacgatggagtgttggggataatcgcagtcgatgaccgcgacattgaaaccctttacatagtgcaggtaagaggctgccagcaccgtgagggtggttttgcccgctccgcctttctgggtggagaaggccacgaatttcgttttctctttcattgttccatgcgtttttagttatacaatcgggtaatcgttcatctcttcacgtattcgggcaagtgacggcatgagattttatgcaggtatgccggcacgcatatatgctggtgcgctggcaggctgttacgccggtatgccggtgcatgggcgcgtgtccgattttatactcatgcacaaccgcatttgcttatccggacaaagacccgctttttcctctgcacacggtgttttctgcatccgtccgcacgtgtgcggacagggggatgtgtcattgcccgtatccgttctcacgtgcaaagtaaacccttaaaaacacgggttgtatgctctttttccgctatggccgcgtgtggcgtcaaagtggacgcaagtggcgtaatcgcttgtagtacaagagattgaataggtaggtatctttgcctcgtgaacgatcccgacgctaatgaagccgtccttgccccgttttacggcggctctttcaatgttctgtccgcgagcgggcagaaggtatttgcaaagggcaaatagcaagctgtgttttctgctgcacgattctcgttttgcagcagaaaacagcttgcccgcaagggggagaaagcacctccggagtcggtgcttttcagaagggcggcaagccgcgaagggatcggaattttcaggaaccggtggggccctggcctctccttaaaatttcgatgcgatggaaaagaacagaaagccccgagggggcaaagggggacgacccgcgaaaaacgacccggccgtttaccgcttttcggtaaacttttcagccgtggaacatgcccgtttcctcgacctttacgagcagtccgggctattgtccaaagccgcttttatcaaagcgagagtgttcaacgaggcgttccgggtggtaaagaccgaccggggaacgctcgaatacgtggcgaagctgaccgctttccacgcccaattccgtgccgtgggaacgaattacaaccaggtggtgaaggagctgcacgcgcatttttccgagaagaaaacactcgcgctgctctataaactggagagagcgacacgtgaactggcggccgtcgggcagcaggtcgtgtcgctctccgaagagttcaaacagcgatggtagccaatatcaccaccggaaaagacgtgtacggcgcgctggcgtacaaccaggagaaagtcgatcggggcgacgggaaggtgctgctgacccacatcgtgagggagccggcggatgggcgcttcaacgtggccgcgacggcagaagacctcctgcgctggatgccctcgcactaccggacggaaaaacccgtcgtgcacgtgtcgctcaacccggctcccgaagaccgcctcgacgacgggcaactcgcggagatagccggggcctacatggagcgcatgggctggggaggacaaccttatatcgtattcaagcataccgacatcggacgggagcatatccatatcgtgtcggtgcaggtggcccaggacgggcgcaagataaacgacagcaggcgcaacgaacgcagcgtggccgttaccgaggaactggaacgggagtacggactgcatcccgccaaagggagaaggcgggagaaagggcaagggatcgtccccgccgattacacgcggggcgacctgaaacgccaggtggcagcggtaataaaaccggccgtggcgacataccgcttccagaccctcggcgagttccgggcattgttgtccttatataatataggtatagaggaagtccggggagagcggaacggaaccccctaccggggattgctctacacgctgctggacgagaacggggacaaggcagtggccgcgccgctcaaatcctcactgttcggtaaagaggtcgggtatgacgggctggaacggcacatggagcgcaacgccgaacggttcgggaaggacgacacgaggaggcaaatccgtggccgggtcgataaagcgcttcggggagaacccacggaggaagaactgcgcgaacgcctgcggggagcccgggtggatctctacatacgacgcaacgaaaacggccgcatcgtgggagtgacgttcattgaccacgaaacacggacggtcgtgaacggatcacggctgggaaaggcatactcggccaacgccttcgagctgcgcttcggcgggaaacggaatcccggggaaaacacgagggacttgtccccgaaacaagcgcctgccggacgggacgggcaacggaagcggaatacctcacgacggaggaaagtataacatctcaattatcattcatttattaaattttacggttatgcaacaggaagacgaccttcggggtcttgcaaaaacaatggatttcatgcgggcattgagtatcttgttcgtggttatcaacatctactggttctgttacgggcagatacgggaatggggaatcaatatcggcgtggtcgataggattctgctgaacttcgaccgcaccgcggggctgttccggaatatactatggacgaaacttttcgccgtcgtgttcctcgccctttcatgcctcgggacaaaaggagtaaaagaggagaaaattacctggcggaaaatcacggcatcgctggccacgggaggcgtgctgttcttcttcaactggtggctgctggacttgccgctgacggcagcggcgaacgcggctttctacatactgaccctatcggccgggtatatctgcctcttgatgggcggcgtgtggatgtcccgcctgctgaagaacaatctcatggatgaccctttcaataacgagaacgaatcattccagcaggaaacacgcctgatcgagaacgagtactccataaatctgccgacgaaattttactataacaaacagtggaacaacgggttcgccaacgttgtaaacccgcaaagggcttgcatctgcatgggaagcccgggcagcgggaagagttattgtgttgtaaaccagtttattaaacagcaaatcgaaaagggctatacccaatacatctatgactacaagtttcccgatctttcggaaatcgcttacaaccacctgctgaatcaccagaaaggttacaagaaaatcccgactttctacgtcataaatttcgacgacccgcgccgctcgcaccgctgtaaccccattcacccggacttcatgaccgatatttcggacgcctacgagagcgcctataccatcatgctcaacctgaaccgaagttgggtgcagaagcagggcgatttttttgtggaaagccccattatccttttcgcggccgtgatctggttcctgcgcatctacgacaacgggcggtattgtaccttcccgcacgccatcgagttcctgaacaagcggtacgaggatattttcccgattctgacatcctacccggaactcgaaaactacctcagcccctttatggatgcctggctcggaggcgctcaagaccagctccagggccagatagcatcggccaaaattccgctttcccgcatgatttcgccccagctatattgggtcatgtcgggcgatgacttcacgctcgacatcaataacccggacgatcccaagatactctgcgtggggaacaatcccgacaggcaaaacatttacggagcggctttgggattgtataattcccggattgtcaagctcataaataagaaaggccagctcaaatcgggcatcatcatcgacgagctgccgacaatctacttcaagggactcgacaacctgatcgccacggccagaagcaacaaggtcgccgtgctgctgtgcttccaggatttttcacagttgaagagggactacggggacaaggaggccgccgtcgtgatgaacacggtgggcaacatcttctccgggcaggtcgtaggtgaaacggccaaaacactctcggaacggttcggtaaggtattgcagaagcggcagagcatgacgttgagccgcagcgacaaatcgacatccatatccacgcagctggacagcctgatcccggcctcgaagatctcgacgctcacgcagggaatgttcgtcggggccgtggcggacaatttcgacgaacgtatcgagcagaagattttccactgcgagattgtcgtggacaacgaaaaagtgaaagcggaaacggcccggtacaagaagataccacaaattaccgacttcacggatgagaatgggacggatcacatgaaacaggtcgtgcaggaaaactacgaacgtatcaaggcagaggccggccgcatcgtcgccgaggagctggaacgtatcaagaacgacccggtgctttgcaagctcctgccggaacagaactaaatgaacacaaacaccccgcaaacaccctccgttaccttaacgggggctgtttcctggttttataaccgcacagctggtgttttggagcataaagtagtgattatgtgaacggaaaacattatttttgtgttcggaatccttttaattataagtatgacagttaccgatatatacgaagcaatgaacagcaaggcggaaacgtttttcgagtggttgcaggctcacccgcaatacgggttgctgtttggtgtcgggttgcttgccctatggcttgcagggttgctgttccgttggaaatgggcgtgtcattggcagtttaacagcaaactgtggttatttgacgattgcaagcctgaaacacgccgcagggttcagattgtgttggtcagcgttctgattatacttatattggttggtttctttgtatggagataacggtatggaaaaggacaatcgcaaataccggatctgcttcatcgactatatgtggtatgtagccgagatatggcacgaaagggagcgtaccaatctcaacggacgtatgctactgttttggtgctggctcttcgtcctactcataccgcttgggtttccaccgatattgcgccttttcggctggatgattggtttggccatagtgattcctctctgctttcttcccgatttattctgcaagctacgctatacagccggacggcgtgaagcgctccgtgaacattacgggaagatgaaacatcccggcaggaagctcgccaaaatagttcttatcgctatcgccctgatcgtggcaaatgtagcgctgatgttccacctcggatttatacattgggcatgatgaaacggcaggagaataagcaacggttttatctctgggattacctctggtggatgggggagaaatggaagcaggcaagacgaacaggcagggtcgatggcgaaatgatgctctcgatttatatcttcgctcttttgatattccctatgatgactgttactatccggctttttccaggtgtgtcggcattgttgccatgtgtcgtttttagcattgtcacatttgccgttatgtcgctcgtcagcaggatttacaaatggcgaggcaaagcagtgatgtctcactatgccaagtgcaggtttaacgaactccttgcggttctgttatttttccttgcgatggccattatctgctttatgatgtatcttcttgacaaaaagtgatacatactttgatacgaactccgggccgttatatcgaatggtctaactcgatgtaccagtttcccttgatgggcttgtaaagcgtggtgtcgttgtacgtcctgcggtagatctcgttcaggtcgccatgttcggtgatacggatattccgacggcttctcaatccgggatcgtaaacgaaactcttggaagttcccgcatccacgatgccgtgggagtagtacggcataacgaggctcacatataccgaatctgccgttccccattccctgcgatcaacaaggataaaaccgcatccaatctctgataacagggagtcgagtaggattcgctccggcttcaacagtccatataccgggatgtcttgttcatcattcgtttcatgggatgtatcgctttgctccattgaatcaagtataataacctcttccggagaaagcggcgggtagtgaaaactaccttctgaactctctgccatgatttcgtacaccttacggaacgccacctcgtgcgtggtgaaatggcgtatcatttcctcgtccgacggcggcatgggaggctctccgcagcttacggcaagcaggattacaaataacaggattatgactggtgttctcattttctaatgtttaatgttctgtggctaaccaatcttgtttagggagttgagccatttgttaatagcatccaatctgttattctgtttaatggtatcttcatttctacataatttgatttgccgaataacggagttctgcataattgaatcggatttgaaaagcagttctaaaacggcttcataacatttggaatatctggacaattcatccaatatatttgcgtcttttagaatatacaggttgaaattgtacacaaatgacttgtaactgaaaatctccgactgtaatgctgctgcatcaagacaagtataaaacaattccttatcgtgctgatatagccacatataatcagatgggttcaggttgtagtgcaataaagtttccgaacggacaaatggaagccctgtatttgagcctaccagataacggtatgtctcattgactattgactcaactatttcaatggattctgattgtttgtccgattcccgtatttctgtaaatgtatcggcaataagaacttccacatcctgcgatttgtaatatataccgtttttttgccagcggaatctacggatatattcttcagaagtcggacaacagaacagtaaagtatttaacaatcggctcagatatattcgcttatctggaatatgacaacggtgtaaccctattatggagccataagcgtatagctttccaaactcgttttcctccgaatttgaatttttaggcatgtaatacaaccgcacaatattgtcaatgaaataatatatatcaagatatttcaatgtatcagccgattctccatatttgttaagtaaatgccgctccagtttctcgccataccataagtagtcatcgggatttatttgaaacaaccgatgaaacttaggttttgataatgaaaagttcttgtttctacttttcattcgttccagtaaggcgacaataattctattcgttatatccatagctgtaatgttcggtggataatcaatctttcagagagatttatctgcttgttataaacctatttgaaatttgtcagtatatcattctttttattggaagacaacatttctaataaatgattaaagctatcgcaaacaaattctgccgaatcttcaaattcaggttcaactccataatagattttaccgtaattttccggagataaatctatgcacaaatattggtatccatcttttactgacataagaataggaatatggctatcccaaaacaggcgtatcatatcacaggattccttatcatctgccaacgcctcaagtcccatcagctcaaattcattccaacggaatccgctatcgctttctccgttaaagtcctctatggaattaaaccaaacattatcactttcattcgtgattgtctgaaaccgttgtaaaaactcctgatagtccgcaggaagttcggagtaccgattttgtaaatcagagcttaaatcttttctttccaatcgttctgtaacgatgaatcctatatttttcagtgcttcaatcatatttttattttacgagtttataatggttggtggctaaccgaccttttctggggaggtttagccgcatgttaatcgtctttattggattaaatgtattattaaagatacttcgtctttttggtaatgataagtttttattatacaagatgttttttgtagtgataaaaacactttaaccgatgcttcacaatagggagacaaagaatcaaataggactaattcagtagaatcccattttacttcaacttcttctatcggttctgccccagttactatatcattctccagaagtttttccaccgttagataatcgggagcatacttccaacgaattattaaaattgctccatctttatttactatgcgtgtagccatcggttcatctcccattaccaataagacatgattgtctatatagattttccccaagtaatctgttacgctacatatagcattgtagttttcttgacccttccattgatgggcatattgttgctcaacaatgacaaatgggcttcctgatgtttcaatccaattattcatattttttctcagcgattaatgttcggcggataaaccaccttaaaagtttcatctgtttgttatcgacctattttatttttagtttttgactatatgcaagtattacgaaacgattatctaatccacaatcaattacatcattcttttctaattgagaataggcttttacaaatctatttcgacatttacttgaatgtatgtaatgattgaagtagttctcggcttgttccttttcaccatatctcaacatatatggcagggcaaggagagagtctttcgtgtattgattgaaacaacagccatgttgcgtaatgaagtcaatagccatttgtctattctcaaataaatcaaatatcggacaagcatatttttcaagtaaatcaattattgtttttattgatggagcatagcttagtccggcaagatcccaagattgatattgatttattggcgataggtatccaatatgattatgatatactaagccatcatcattgacattaagattttcttcttgcacccactttttcaagtttttacaagtaatcgtaatcagtggatatatagccacactacaagatgaattatatacacttgaacgaaaccatatttcaaaagtcaaatctttgtcttttgaaatcttttttaggcattgtccatttttagacggcttaaatcccattgcaataaaaggaatagctatctcattgcaggctttaataaatatatctcttggtttcatttcttgttcttttcaggtcgataatgttcggcggataatcgactgttagggagattaatccgcttgttatgcgctttatttaataatacaattatttacttttataaaatgacttccttcaatatcttttagtgcggtaggacttattttcaccttagttctatgcacattttcacctattgtaatcgtcagatttctacataattgctttatcctttctactaccacttggtacacgtcattataattttccaattcgttacatagtatttctctattttcctctattgaatatattttcttagggtactctaattgaacccccattatattctctggaaaatttatgtaactgaatttggtttgtaacttatgttcttcatcaagatagaaggcaaatagattgaacccgacgcaaggctctatgaaatcctctgttttataccataatccatcatttgaatcttgaaaggggactttatacgcacacttacttagattgtttgaaaagcccgtgagcaaattgtcgattacaatatgctcgattttttcaccggacgttagtaaacggtaaaaagattcgtaatcccttacaaaatttgcaaagttactttctatataatccgcaggtactctacggttgtatatcacaatgtgaaatcctcgcaaaatgtctttcaattcttgcggtgtaaccaagaacttgtaagtatgccatccttttggataatatttcatgctcatattgtattagtttctaagcgcataatgttcggcggataatcatcattaaaggagattgatccgcttgttatctgcccgctttattcctcttcttcgatgaaatgatttataaagtaattgaatgactgggcgatgtaacgagtatttgtttcaaagttgtattctcttgaagcgttttcgtcccactcgtcagtcaagtaatagtaaatctttttattcttcaagttcaacgcataatagtttccacccgaatccatagcaaaaggcaacagattgcatggcattaaattcctactccatatatctttggctatgacttcaattgtttcaaaagcattggtgcgttcctttatcggaaagaacgcatttatctccacccgatccaaatcctcgtcctgcggttgataacaatatggtgatggcataccaccgttgaacttgaggtaaaagttcttcatgcctgccggaatctttacattcaactcaacctcaaaattctttatatcttcttttgttagcgaagccgaacagtccgaaagttcaggcattacacctgctgtctccgtttgtccctcttcgatttcttctattgctggaattgctttgtgcccgtccaaaacaacgagattgtcaaagaaatcatctattgaatttgcaacaagtcgtggctctccaaaattgaagattacatcttgcatccccacaatagggtaaagatagatctttccattaaccaagtctatggtaatccgaccttcatcggtagattccatagcaaaaataagaatgctatcagatatagctcctgcttttcttaactctaatgtttcgccttctgccgtatatctggggtcattcttaaaatccttgttatatttgaatgggaagaaatcttcaatttccacctcttgatatttatttatgcttgcgatctgtttcgtagaacctccattatattgtaaatagaactctttcagtctttccggcaaggcataacccaatttactctctatttcttcaaaatctttgagagtaagacttttttggcaattttctaattctattttcatattcattctttttatgggcagataatgtttggcagctaaccgacctttaaggggaggttgagccgcttgttattctttcaatttggatatggagtgtaatattacagctcttctattggttataccggtttcttcacatatacaagcaattccatcagacaatattatggcaaagccaaaattcgactgtattcctgcatttatagcctctgatatatctgcccatttttgatccagctcaaaaaaaccgatgcaatatccttctttctctttagataattcacgaagtctatctgtcaaatggattaaatccgtagaattatagacctcgacaatcttattctcatttataatatccatcatattatgacaaattcgactaatagcttttactctttttttgtttgatgacagttcaaaaaagaaacggtcttgataaccagacttaatgaattgcttacaaaaaaaatcttctatggtatttcctttattcatatccaattcttttgaagaataatgggttgtaaatagcaactgttagggttgcttatttacttgttatccgcacattaattctcttcatcattgccataggctaattctatatcaataaactgaattaccaactgacatatttcgccgccttcgtctatgccccaataaaccggatacgtaccatctccgaaccctgattgaaaaatgggaatatgatactccgtccccggcacttgccaatttaaccagtctccgcctgcacgttgatattctggatggagataatagttttctttgaataatgcagcaaaatatccatcataaggattatcatcgggattatctttgcgccattgttcatcccagtcgcaataaatacggtggataatttcatcacatacacatcctaaaccagcatctacacaaaatccaaagtaatcaccctcttccaatgtttcaaggttttcattcccaactaatgcttcatagaatcgaacagcccgcttttcattgaagcgcaaacgtactgcggcataacggtcgcaatcctcgtcgtcagatttgattacacaaatttccgtttcatatttacccgcaggagcgttctgaaaatatggacgttcgtttctgtttgggagatataccaatggatctcgtaccaaaagatttccactcggcaaatcgcaagaaccgatattaatcgtcgttaacgattttcctgcaatttcttcttgctcaaaataagtattgaggtcaacagggcagacggttttttcttttaccgattcccattttttcatccagttgttttctaattctttcatattcctttttgatttttagttgcggataatgtttggtggctaaccgacctttttaggggaggctaagccgcttgttatatgccatttccaaattattaaagatattaaaacctatatatgattctttgttggggtatctcgacctataatagcaattccaataactaatcatttgatttttagttcgatcaaagaatttttcattttctccgataaaacgaaggtatctatccatattacactccaaatgcttcttcacatcgtataaaatattatctacatattctcctaatagcttaaagcaaaatggtatagtccaatattctgtgcaggagattaggttttgtagatggtgttgccttacaaaaccattattatgtcttgtgaaaatacagtcaagaatatttctttgtattgctgtcatattggacggtgtctgttctctcatatatacccgttctggaattgctatattcaaacctccaagattgacgatatagtatcggctgcttatatcatcatttttcatcacaagcatatccaatactctccgtacatcttttgcgagatccggaggaaatgaatttaatattttatccttttcatacatggcatataatgtttggtggataatcaaccttttaagggagatttatccacttgttatggtagtt
